(12) United States Patent
Zhang et al.

(10) Patent No.: US 11,472,881 B2
(45) Date of Patent: Oct. 18, 2022

(54) SINGLE-DOMAIN ANTIBODIES AND VARIANTS THEREOF AGAINST CTLA-4

(71) Applicant: NANJING LEGEND BIOTECH CO., LTD., Nanjing (CN)

(72) Inventors: Yafeng Zhang, Nanjing (CN); Shu Wu, Nanjing (CN); Shuai Yang, Nanjing (CN); Chuan-Chu Chou, Westfield, NJ (US)

(73) Assignee: NANJING LEGEND BIOTECH CO., LTD., Jiangsu (CN)

( * ) Notice: Subject to any disclaimer, the term of this patent is extended or adjusted under 35 U.S.C. 154(b) by 414 days.

(21) Appl. No.: 16/341,034

(22) PCT Filed: Oct. 10, 2017

(86) PCT No.: PCT/CN2017/105506
§ 371 (c)(1),
(2) Date: Apr. 10, 2019

(87) PCT Pub. No.: WO2018/068695
PCT Pub. Date: Apr. 19, 2018

(65) Prior Publication Data
US 2019/0233519 A1    Aug. 1, 2019

(30) Foreign Application Priority Data

Oct. 11, 2016  (WO) ................ PCT/CN2016/101777
Jul. 20, 2017  (WO) ................ PCT/CN2017/093644

(51) Int. Cl.
| | | |
|---|---|---|
| C07K 16/28 | (2006.01) |
| A61P 35/00 | (2006.01) |
| A61K 47/65 | (2017.01) |
| A61K 47/68 | (2017.01) |
| A61K 39/395 | (2006.01) |
| A61K 39/00 | (2006.01) |
| A61P 31/00 | (2006.01) |

(52) U.S. Cl.
CPC ...... *C07K 16/2818* (2013.01); *A61K 39/3955* (2013.01); *A61K 47/65* (2017.08); *A61K 47/6849* (2017.08); *A61P 35/00* (2018.01); *C07K 16/2827* (2013.01); *A61K 2039/505* (2013.01); *A61K 2039/507* (2013.01); *A61P 31/00* (2018.01); *C07K 2317/22* (2013.01); *C07K 2317/24* (2013.01); *C07K 2317/31* (2013.01); *C07K 2317/51* (2013.01); *C07K 2317/515* (2013.01); *C07K 2317/52* (2013.01); *C07K 2317/522* (2013.01); *C07K 2317/53* (2013.01); *C07K 2317/55* (2013.01); *C07K 2317/56* (2013.01); *C07K 2317/565* (2013.01); *C07K 2317/567* (2013.01); *C07K 2317/569* (2013.01); *C07K 2317/73* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | |
|---|---|---|
| 3,773,919 A | 11/1973 | Boswell |
| RE30,985 E | 6/1982 | Cartaya |
| 4,419,446 A | 12/1983 | Howley |
| 4,560,655 A | 12/1985 | Baker |
| 4,601,978 A | 7/1986 | Karin |
| 4,657,866 A | 4/1987 | Kumar |
| 4,676,980 A | 6/1987 | Segal |
| 4,767,704 A | 8/1988 | Cleveland et al. |
| 4,816,567 A | 3/1989 | Cabilly |
| 4,927,762 A | 5/1990 | Darfler |
| 4,965,199 A | 10/1990 | Capon |
| 5,122,469 A | 6/1992 | Mather |
| 5,229,275 A | 7/1993 | Goroff |
| 5,264,365 A | 11/1993 | Georgiou |
| 5,500,362 A | 3/1996 | Robinson |
| 5,508,192 A | 4/1996 | Georgiou |
| 5,545,806 A | 8/1996 | Lonberg et al. |
| 5,545,807 A | 8/1996 | Surani |
| 5,565,332 A | 10/1996 | Hoogenboom et al. |
| 5,567,610 A | 10/1996 | Borrebaeck |
| 5,569,825 A | 10/1996 | Lonberg |
| 5,571,894 A | 11/1996 | Wels |
| 5,573,905 A | 11/1996 | Lerner |
| 5,587,458 A | 12/1996 | King |
| 5,591,669 A | 1/1997 | Krimpenfort et al. |
| 5,591,828 A | 1/1997 | Bosslet |

(Continued)

FOREIGN PATENT DOCUMENTS

| | | |
|---|---|---|
| CN | 1388136 A | 1/2003 |
| CN | 102369215 A | 3/2012 |

(Continued)

OTHER PUBLICATIONS

Jin et al (Cell Biochem Biophys. 2013;67(3):1067-74.) (Year: 2013).*

(Continued)

*Primary Examiner* — Brian Gangle
*Assistant Examiner* — Andrea K McCollum
(74) *Attorney, Agent, or Firm* — Morrison & Foerster LLP

(57) ABSTRACT

The present application provides constructs comprising a single-domain antibody (sdAb) moiety that specifically recognizes cytotoxic T-lymphocyte-associated protein 4 (CTLA-4). Also provided are methods of making and using these constructs.

21 Claims, 58 Drawing Sheets
Specification includes a Sequence Listing.

(56) References Cited

U.S. PATENT DOCUMENTS

| | | |
|---|---|---|
| 5,624,821 A | 4/1997 | Winter |
| 5,625,126 A | 4/1997 | Lonberg |
| 5,633,425 A | 5/1997 | Lonberg et al. |
| 5,639,635 A | 6/1997 | Joly |
| 5,641,870 A | 6/1997 | Rinderknecht |
| 5,648,237 A | 7/1997 | Carter |
| 5,648,260 A | 7/1997 | Winter |
| 5,661,016 A | 8/1997 | Lonberg et al. |
| 5,731,168 A | 3/1998 | Carter |
| 5,739,277 A | 4/1998 | Presta |
| 5,750,373 A | 5/1998 | Garrard |
| 5,770,429 A | 6/1998 | Lonberg et al. |
| 5,821,337 A | 10/1998 | Carter |
| 5,837,234 A | 11/1998 | Gentile |
| 5,840,523 A | 11/1998 | Simmons |
| 5,869,046 A | 2/1999 | Presta |
| 6,013,605 A | 1/2000 | Rees |
| 6,027,888 A | 2/2000 | Georgiou |
| 6,075,181 A | 6/2000 | Kucherlapati |
| 6,083,715 A | 7/2000 | Georgiou |
| 6,150,584 A | 11/2000 | Kucherlapati |
| 6,194,551 B1 | 2/2001 | Idusogie |
| 6,602,684 B1 | 8/2003 | Umana |
| 6,737,056 B1 | 5/2004 | Presta |
| 6,982,321 B2 | 1/2006 | Winter |
| 7,041,870 B2 | 5/2006 | Tomizuka |
| 7,087,409 B2 | 8/2006 | Barbas, III |
| 7,189,826 B2 | 3/2007 | Rodman |
| 7,332,581 B2 | 2/2008 | Presta |
| 7,371,826 B2 | 5/2008 | Presta |
| 7,371,849 B2 | 5/2008 | Honda |
| 7,504,256 B1 | 3/2009 | Ogawa |
| 7,521,541 B2 | 4/2009 | Eigenbrot |
| 7,527,791 B2 | 5/2009 | Adams |
| 8,754,287 B2 | 6/2014 | Macdonald |
| 10,385,137 B2 | 8/2019 | Baty et al. |
| 2002/0164328 A1 | 11/2002 | Shinkawa |
| 2003/0115614 A1 | 6/2003 | Kanda |
| 2003/0157108 A1 | 8/2003 | Presta |
| 2004/0093621 A1 | 5/2004 | Shitara |
| 2004/0109865 A1 | 6/2004 | Niwa |
| 2004/0110282 A1 | 6/2004 | Kanda |
| 2004/0110704 A1 | 6/2004 | Yamane |
| 2004/0132140 A1 | 7/2004 | Satoh |
| 2004/0259150 A1 | 12/2004 | Nakamura |
| 2005/0014934 A1 | 1/2005 | Hinton |
| 2005/0031613 A1 | 2/2005 | Nakamura |
| 2005/0079574 A1 | 4/2005 | Bond |
| 2005/0119455 A1 | 6/2005 | Fuh |
| 2005/0123546 A1 | 6/2005 | Umana |
| 2005/0255115 A1 | 11/2005 | Huang et al. |
| 2005/0266000 A1 | 12/2005 | Bond |
| 2005/0272916 A1 | 12/2005 | Hanai |
| 2006/0025576 A1 | 2/2006 | Miller |
| 2007/0061900 A1 | 3/2007 | Murphy |
| 2007/0071675 A1 | 3/2007 | Wu et al. |
| 2007/0117126 A1 | 5/2007 | Sidhu |
| 2007/0134759 A1 | 6/2007 | Nishiya |
| 2007/0160598 A1 | 7/2007 | Dennis |
| 2007/0178552 A1 | 8/2007 | Arathoon |
| 2007/0237764 A1 | 10/2007 | Birtalan |
| 2007/0292936 A1 | 12/2007 | Barthelemy |
| 2008/0241884 A1 | 10/2008 | Shitara |
| 2009/0002360 A1 | 1/2009 | Chen |
| 2009/0307787 A1 | 12/2009 | Grosveld |
| 2010/0122358 A1 | 5/2010 | Brueggemann |
| 2011/0028695 A1 | 2/2011 | Revets |
| 2011/0287009 A1 | 11/2011 | Scheer |
| 2013/0156769 A1 | 6/2013 | Kufer et al. |
| 2013/0189735 A1 | 7/2013 | Zardi |
| 2014/0127210 A1 | 5/2014 | Kim |
| 2015/0086541 A1 | 3/2015 | Aguilar-Cordova |
| 2015/0202291 A1 | 7/2015 | Bosch et al. |
| 2015/0232555 A1 | 8/2015 | Carven |
| 2015/0289489 A1 | 10/2015 | Macdonald |
| 2016/0000842 A1 | 1/2016 | Song et al. |
| 2016/0083476 A1 | 3/2016 | Baty et al. |
| 2016/0145355 A1 | 5/2016 | Saha et al. |
| 2016/0166685 A1 | 6/2016 | Cheung et al. |
| 2016/0272960 A1 | 9/2016 | Thanos et al. |
| 2019/0202935 A1 | 7/2019 | Chou |
| 2020/0369770 A1 | 11/2020 | Zhang et al. |

FOREIGN PATENT DOCUMENTS

| | | |
|---|---|---|
| CN | 105754990 A | 7/2016 |
| EP | 0308936 A2 | 3/1989 |
| EP | 0368684 A1 | 5/1990 |
| EP | 0404097 A2 | 12/1990 |
| EP | 1792991 A1 | 6/2007 |
| EP | 3263702 A1 | 1/2018 |
| EP | 3459597 A1 | 3/2019 |
| WO | 1987000195 A1 | 1/1987 |
| WO | 1990003430 A1 | 4/1990 |
| WO | 1991000360 A1 | 1/1991 |
| WO | 199110741 A1 | 7/1991 |
| WO | 1993001161 A1 | 1/1993 |
| WO | 1993008829 A1 | 5/1993 |
| WO | 1993011161 A1 | 6/1993 |
| WO | 1993016185 A2 | 8/1993 |
| WO | 1994004678 A1 | 3/1994 |
| WO | 1994004690 A1 | 3/1994 |
| WO | 1994011026 A2 | 5/1994 |
| WO | 1994029351 A2 | 12/1994 |
| WO | 1996016673 A1 | 6/1996 |
| WO | 1996027011 A1 | 9/1996 |
| WO | 1996033735 A1 | 10/1996 |
| WO | 1996034096 A1 | 10/1996 |
| WO | 1996034103 A1 | 10/1996 |
| WO | 1997017852 A1 | 5/1997 |
| WO | 1997030087 A1 | 8/1997 |
| WO | 1997049805 A2 | 12/1997 |
| WO | 1998022141 A2 | 5/1998 |
| WO | 1998024893 A2 | 6/1998 |
| WO | 1998050431 A2 | 11/1998 |
| WO | 1998058964 A1 | 12/1998 |
| WO | 1999022764 A1 | 5/1999 |
| WO | 1999037681 A2 | 7/1999 |
| WO | 1999051642 A1 | 10/1999 |
| WO | 2000027435 A1 | 5/2000 |
| WO | 2000043507 A1 | 7/2000 |
| WO | 2000061739 A1 | 10/2000 |
| WO | 2001014424 A2 | 3/2001 |
| WO | 2001029246 A1 | 4/2001 |
| WO | 2001077137 A1 | 10/2001 |
| WO | 2001090190 A2 | 11/2001 |
| WO | 2002031140 A1 | 4/2002 |
| WO | 2002085945 A2 | 10/2002 |
| WO | 2003011878 A2 | 2/2003 |
| WO | 2003014161 A2 | 2/2003 |
| WO | 2003025020 A1 | 3/2003 |
| WO | 2003035694 A2 | 5/2003 |
| WO | 2003084570 A1 | 10/2003 |
| WO | 2003085107 A1 | 10/2003 |
| WO | 2004042072 A2 | 5/2004 |
| WO | 2004049794 A2 | 6/2004 |
| WO | 2004056312 A2 | 7/2004 |
| WO | 2004092219 A2 | 10/2004 |
| WO | 2005035586 A1 | 4/2005 |
| WO | 2005035778 A1 | 4/2005 |
| WO | 2005053742 A1 | 6/2005 |
| WO | 2003085119 A1 | 8/2005 |
| WO | 2005100402 A1 | 10/2005 |
| WO | 2006003388 A1 | 1/2006 |
| WO | 2006008548 A2 | 1/2006 |
| WO | 2006029879 A2 | 3/2006 |
| WO | 2006030220 A1 | 3/2006 |
| WO | 2006138670 A2 | 12/2006 |
| WO | 2007112940 A2 | 10/2007 |
| WO | 2008077546 A1 | 7/2008 |
| WO | 2008156712 A1 | 12/2008 |
| WO | 2009068649 A2 | 6/2009 |
| WO | 2009089004 A1 | 7/2009 |
| WO | 2010097597 A1 | 9/2010 |

(56) References Cited

FOREIGN PATENT DOCUMENTS

| WO | 2010112193 | A1 | 10/2010 |
|---|---|---|---|
| WO | 2011036460 | A1 | 3/2011 |
| WO | 2012155019 | A1 | 11/2012 |
| WO | 2012158818 | A2 | 11/2012 |
| WO | 2013019906 | A1 | 2/2013 |
| WO | 2014209804 | A1 | 12/2014 |
| WO | 2016024231 | A1 | 2/2016 |
| WO | 2016061142 | A1 | 4/2016 |
| WO | 2016154473 | A1 | 9/2016 |
| WO | 2016187594 | A1 | 11/2016 |
| WO | 2017143406 | A1 | 8/2017 |
| WO | 2017165681 | A1 | 9/2017 |
| WO | 2018014260 | A1 | 1/2018 |
| WO | 2018014855 | A1 | 1/2018 |
| WO | 2018068201 | A1 | 4/2018 |
| WO | 2018068695 | A1 | 4/2018 |

OTHER PUBLICATIONS

Vajdos et al. (J Mol Biol. Jul. 5, 2002;320(2):415-28 at 416) (Year: 2002).*
Brown et al. (J Immunol. May 1996;156(9):3285-91) (Year: 1996).*
Almagro, J. et al. (Jan. 1, 2008). "Humanization of Antibodies," Frontiers in Bioscience 13:1619-1633.
Arie, J-P. et al. (Jan. 1, 2001). "Chaperone Function of FkpA, a Heat Shock Prolyl Isomerase, in the Periplasm of *Escherichia coli*," Molecular Micorbiology 39(1):199-210.
Armour, K.L et al. (1999). "Recombinant Human IgG Molecules Lacking Fcγ Receptor I Binding and Monocyte Triggering Activities," Eur. J. Immunol. 29:2613-2624.
Baca, M. et al. (Apr. 18, 1997). "Antibody Humanization Using Monovalent Phage Display," J. Biol. Chem. 272(16):10678-10684.
Bachmann, B.J. (1987). "Section G. Strains and Useful Strain Constructions. Derivations and Genotypes of Some Mutant Derivatives of *Escherichia coli* K-12," Cellular and Molecular Biology, vol. 2, Neidhardt, F. C. et al., Washington, D.C., American Society for Microbiology, pp. 1190-1219.
Balzano, C. et al. (1992). "CTLA-4 and CD28: Similar Proteins, Neighbouring Genes," Int. J. Cancer Suppl. 7:28-32. (Abstract Only).
Barbas III, C.F et al. (Apr. 1994). "In Vitro Evolution of a Neutralizing Human Antibody to Human Immunodeficiency Virus Type 1 to Enhance Affinity and Broaden Strain Cross-Reactivity," Proc Nat. Acad. Sci. USA 91:3809-3813.
Barnes, D. et al. (Mar. 1, 1980). "Methods for Growth of Cultured Cells in Serum-Free Medium," Anal. Biochem. 102(2):255-270.
Bass, S. et al. (1990). "Hormone Phage: An Enrichment Method for Variant Proteins With Altered Binding Properties," Proteins 8:309-314.
Boerner, P. et al. (Jul. 1, 1991). "Production of a Antigen-Specific Human Monoclonal Antibodies from in Vitro-Primed Human Splenocytes," J. Immunol. 147(1):86-95.
Bothmann, H. et al., (Jun. 2, 2000). "The Periplasmic *Escherichia coli* Peptidylprolyl cis,trans-Isomerase FkpA," The Journal of Biological Chemistry 275(22):17100-17105.
Brennan, M. et al. (Jul. 5, 1985). "Preparation of Bispecific Antibodies by Chemical Recombination of Monoclonal Immunoglobulin G1 Fragments," Science 229:81-83.
Brüggemann, M. et al. (1993). "Designer Mice: The Production of Human Antibody Repertoires in Transgenic Animals," Year in Immuno. 7:33-40.
Brüggemann, M. et al. (Nov. 1, 1987). "Comparison of the Effector Functions of Human Immunoglobulins Using a Matched Set of Chimeric Antibodies," J. Exp. Med. 166:1351-1361.
Capel, P.J. et al. (Feb. 1994). "Heterogeneity of Human IgG Fc receptors," Immunomethods 4(1):25-34.
Caron, P.C. et al. (Oct. 1, 1992). "Engineering Humanized Dimeric Forms of IgG are More Effective Antibodies," J. Exp Med. 176:1191-1195.

Carter, P. et al. (Feb. 1992). "High Level *Escherichia coli* Expression and Production of a Bivalent Humanized Antibody Fragment," Bio/Technology 10:163-167.
Carter, P. et al. (May 1992). "Humanization of an Anti-p185HER2 Antibody for Human Cancer Therapy," Proc. Natl. Acad. Sci. USA 89:4285-4289.
Chen, J. et al. (Jul. 9, 1999). "Chaperone Activity of DsbC*," The Journal of Biological Chemistry 274 (28):19601-19605.
Chen, Y. et al. (1999). "Selection and Analysis of an Optimized Anti-VEGF Antibody: Crystal Structure of an Affinity-Matured Fab in Complex With Antigen," J. Mol. Biol 293:865-881.
Chothia, C. et al. (Aug. 20, 1987). "Canonical Structures for the Hypervariable Regions of Immunoglobulins," J. Mol. Biol. 196(4):901-917.
Chowdhury, P.S. (2008). "Engineering Hot Spots for Affinity Enhancement of Antibodies," Methods Mol. Biol. 207:179-196.
Clackson, T. et al. (Aug. 15, 1991). "Making Antibody Fragments Using Phage Display Libraries," Nature 352:624-628.
Clynes, R. et al. (Jan. 1998). "Fc Receptors are Required in Passive and Active Immunity to Melanoma," Proc. Natl. Acad. Sci. U.S.A. 95:652-656.
Cole, S.P.C. et al. (1985). "The EBV-Hybridoma Technique and its Applicaton to Human Lung Cancer," in Monoclonal Antibodies and Cancer Therapy, Alan R. Liss, p. 77-96.
Conrath, K.E. et al. (Mar. 9, 2001). "Camel Single-domain Antibodies as Modular Building Units in Bispecific and Bivalent Antibody Constructs" J. Biol. Chem. 276(10):7346-7350.
Cragg, M.S. et al. (2003). "Complement-Mediated Lysis By Anti-CD20 Mab Correlates With Segregation Into Lipid Rafts," Blood 101(3):1045-1052.
Cragg, M.S. et al. (Apr. 1, 2004). "Antibody Specificity Controls in Vivo Effector Mechanisms of Anti-CD20 Reagents," Blood 103(7):2738-2743.
Cunningham, B.C. et al. (Jun. 2, 1989). "High-Resolution Epitope Mapping of hGH-Receptor Interactions by Alanine-Scanning Mutagenesis," Science 244:1081-1085.
Dall'Acqua, W.F. et al. (2005). "Antibody Humanization by Framework Shuffling," Methods 36:43-60.
Davies, J. et al. (1996). "Single Antibody Domains as Small Recognition Units: Design and in Vitro Antigen Selection of Camelized, Human VH Domains with Improved Protein Stability," Protein Engineering 9(6):531-537.
Davies, J. et al. (Feb. 21, 1994). "'Camelising' Human Antibody Fragments: NMR Studies on VH Domains," FEBS Letters 339(3):285-290.
Daëron, M. (1997). "Fc Receptor Biology," Ann. Rev. Immunol. 15:203-234.
De Haas, M. et al. (Oct. 1995). "Fc Gamma receptors of Phagocytes," J. Lab. Clin. Med. 126:330-341.
Duncan, A.R. et al. (Apr. 21, 1988). "The Binding Site for C1q on IgG," Nature 322:738-740.
Fan, G. et al. (2015). "Bispecific Antibodies and their Applications," J. Hematol & Oncol. 8(130):1-14.
Fellouse, F.A. et al. (Aug. 24, 2004). "Synthetic Antibodies from a Four-Amino-Acid Code: A Dominant Role for Tyrosine in Antigen Recognition," Proc. Natl. Acad. Sci. USA 101(34):12467-12472.
Fishwild, D.M et al. (Jul. 1996). "High-Avidity Human IgGK Monoclonal Antibodies from a Novel Strain of Minilocus Transgenic Mice," Nature Biotechnol. 14:845-851.
Fulkerson, P.C. et al. (2013, e-pub. Jan. 21, 2013). "Targeting Eosinophils in Allergy, Inflammation and Beyond," Nat Rev Drug Discov 12(2):117-129, 23 pages.
Gazzano-Santoro, H. et al. (Mar. 28, 1997). "A Non-Radioactive Complement-Dependent Cytotoxicity Assay for Anti-CD20 Monoclonal Antibody," J. Immunol. Methods 202:163-171.
Geering, B. et al. (Feb. 2015). "Synthetic Immunology: Modulating the Human Immune System," Trends Biotechnol. 33(2):65-79.
Ghetie, V. et al. (1997). "Increasing the Serum Persistence of an IgG Fragment by Random Mutagenesis," Nat Biotech 15:637-640.
Ghetie, V. et al. (Dec. 1997). "FcRn: the MHC Class I-related Receptor That is More Than an IgG Transporter," Immunol. Today 18(12):592-598.

(56) References Cited

OTHER PUBLICATIONS

Goding, J.W. (1986). "Production of Monoclonal Antibodies," Chapter 3 in Monoclonal Antibodies: Principles and Practice, Academic Press, New York, pp. 59-103.
Graham, F.L. et al. (1977). "Characteristics of a Human Cell Line Transformed By DNA From Human Adenovirus Type 5," Journal General Virology 36(1):59-74.
Greenberg, A.S. et al. (Mar. 9, 1995). "A New Antigen Receptor Gene Family That Undergoes Rearrangement and Extensive Somatic Diversification In Sharks" Nature 374(6518):168-173.
Griffith, A.D. et al. (1993). "Human Anti-Self Antibodies with High Specificity from Phage Display Libraries," EMBO J. 12(2):725-734.
Gruber, M. et al. (1994). "Efficient Tumor Cell Lysis Mediated by a Bispecific Single Chain Antibody Expressed in Escherichia coli," J. Immunol. 152:5368-5374.
Guss, B. et al. (Jul. 1986). "Structure of the IgG-Binding Regions of Streptococcal Protein G," EMBO J. 5(7):1567-1575.
Guyer, R.L. et al. (Aug. 1976). "Immunoglobulin Binding By Mouse Intestinal Epithelial Cell Receptors," J. Immunol. 117(2):587-593.
Ham, R.G. et al. (1979). "Media and Growth Requirements," Meth. Enzymol. 58:44-93.
Hamers-Casterman, C. et al. (Jun. 3, 1993). "Naturally Occurring Antibodies Devoid of Light Chains," Nature 363(6428):446-448.
Hammerling, G. et al. (1981). "Monoclonal Antibodies and T-Cell Hybridomas," in Monoclonal Antibodies and T-Cell Hybridomas, Elsevier/North Holland Biomedical Press, New York, pp. 563-586.
Hara, H. et al. (1996) "Overproduction of Penicillin-Binding Protein 7 Suppresses Thermosensitive Growth Defect at Low Osmolarity Due to an Spr Mutation of Escherichia coli," Microhial Drug Resistance 2(1):63-72.
Harris, W.J. (1995). "Production of Humanized Monoclonal and Antibodies for in vivo Imaging and Therapy," Biochem. Soc. Transactions 23:1035-1038.
Hassanzadeh-Ghassabeh, G. et al. (2013, e-pub. Jun. 4, 2013). "Nanobodies and their Potential Applications," Nanomedicine (Lond) 8(6):1013-1026.
Hawkins, R.E. et al. (1992). "Selection of Phage Antibodies by Binding Affinity: Mimicking Affinity Maturations," J. Mol. Biol. 226:889-896.
Hellstrom, I. et al. (Mar. 1985). "Strong Antitumor Activities of IgG3 Antibodies to a Human Melanoma-associated Ganglioside," Proc. Natl. Acad. Sci. USA 82:1499-1502.
Hellstrom, I. et al. (Sep. 1986). "Antitumor Effects of L6, an IgG2a Antibody That Reacts With Most Human Carcinomas," Proc. Natl. Acad. Sci. USA 83:7059-7063.
Hinton, P.R. et al. (Feb. 20, 2004). "Engineered Human IgG Antibodies with Longer Serum Half-lives in Primates," J. Biol. Chem. 279(8):6213-6216.
Hmila, I. et al. (Aug. 2008, e-pub. Jul. 9, 2008). "VHH Bivalent Domains and Chimeric Heavy Chain-Only Antibodies With High Neutralizing Efficacy For Scorpion Toxin Aahi," Molecular Immunology 45(14):3847-3856.
Holliger, P. et al. (Jul. 1993). "Diabodies": Small Bivalent and Bispecific Antibody Fragments, Proc. Natl. Acad. Sci. Usa 90:6444-6448.
Holt, L. et al. (Nov. 2003) "Domain Antibodies: Proteins for Therapy," Trends in Biotechnology 21(11):484-490.
Hongo, J.A.S. et al. (1995). "Development and Characterization of Murine Monoclonal Antibodies to the Latency-Associated Peptide of Transforming Growth Factor Beta1," Hybridoma, 14(3):253-260.
Hoogenboom, H.R. (2002). "Overview of Antibody Phage-Display Technology and its Applications," in Chapter 1 of Methods in Molecular Biology, O'Brien, P.M. (ed.) et al., Humana Press Inc., Totowa, NJ, 178:1-37.
Hoogenboom, H.R. et al. (Sep. 20, 1992). "By-Passing Immunisation Human Antibodies From Synthetic Repertoires of Germline VH Gene Segments Rearranged in Vitro," J. Mol. Biol. 227(2):381-388.

Hudson, P.J. et al. (Jan. 2003). "Engineered Antibodies," Nature Medicine 9(1):129-134.
Hurle, M.R. et al. (1994). "Protein Engineering Techniques for Antibody Humanization," Curr. Op. Biotech. 5(4):428-433.
Idusogie, E.E. et al. (2000). "Mapping of the C1q Binding Site on Rituxan, a Chimeric Antibody With a Human IgG1 Fc,"J. Immunol. 164:4178-4184.
International Preliminary Report on Patentability dated Apr. 16, 2019, for PCT Patent Application No. PCT/CN2017/105506, filed Oct. 10, 2017, 7 pages.
International Preliminary Report on Patentability dated Apr. 16, 2019, for PCT Patent Application No. PCT/CN2016/101777, filed Oct. 11, 2016, 9 pages.
International Preliminary Report on Patentability dated Jan. 22, 2019, for PCT Patent Application No. PCT/CN2016/090703, filed Jul. 20, 2016, 6 pages.
International Preliminary Report on Patentability dated Jan. 22, 2019, for PCT Patent Application No. PCT/CN2017/093644, filed Jul. 20, 2017, 6 pages.
International Search Report dated Apr. 12, 2017, for PCT Patent Application No. PCT/CN2016/090703, filed Jul. 20, 2016, 7 pages.
International Search Report dated Jan. 19, 2018, for PCT Patent Application No. PCT/CN2017/105506, filed Oct. 10, 2017, 6 pages.
International Search Report dated Jul. 11, 2017, for PCT Patent Application No. PCT/CN2016/101777, filed Oct. 11, 2016, 7 pages.
International Search Report dated Oct. 11, 2017, for PCT Patent Application No. PCT/CN2017/093644, filed Jul. 20, 2017, 7 pages.
Iwai, Y. et al. (Feb. 2005, e-pub. Dec. 20, 2004). "PD-1 Blockade Inhibits Hematogenous Spread of Poorly Immunogenic Tumor Cells by Enhanced Recruitment of Effector T Cells," International Immunology 17(2):133-144.
Jackson, J.R. et al. (Apr. 1, 1995). "In Vitro Antibody Maturation. Improvement of a High Affinity, Neutralizing Antibody Against IL-1 Beta," J. Immunol. 154(7):3310-3319.
Jakobovits, A. et al. (Mar. 18, 1993). "Germ-Line Transmission and Expression of a Human-Derived Yeast Artificial Chromosome," Nature 362:255-258.
Jakobovits, A. et al. (Mar. 1993). "Analysis of Homozygous Mutant Chimeric Mice: Deletion of the Immunoglobulin Heavy-Chain Joining Region Blocks B-Cell Development and Antibody Production," Proc. Natl. Acad. Sci. USA 90:2551-2555.
Janssens, R. et al. (Oct. 10, 2006). "Generation of Heavy-Chain-Only Antibodies in Mice," Proc. Natl. Acad. Sci. USA 103(41):15130-15135.
Richard, G. et al. (Jul. 22, 2013) "In vivo neutralization of α-cobratoxin with high-affinity llama single-domain antibodies (VHHs) and a VHH-Fc antibody," PLoS One. 8(7):e69495.
Johnson, G. et al. (2003). "The Kabat Database and a Bioinformatics Example," Methods in Molecular Biology 248:11-25, 15 pages.
Johnson, K.S. et al. (1993). "Human Antibody Engineering," Current Opinion in Structural Biology 3:564-571.
Jones, A.J.S. (1993). "Analysis of Polypeptides and Proteins," Adv. Drug Delivery Rev. 10:29-90.
Jones, P. et al. (May 29, 1986). "Replacing The Complementarity-Determining Regions in a Human Antibody With Those From a Mouse," Nature 321:522-525.
Kam, N.W.S. et al. (Aug. 16, 2005). "Carbon Nanotubes as Multifunctional Biological Transporters and Near-Infrared Agents for Selective Cancer Cell Destruction," PNAS 102(33):11600-11605, 6 pages.
Kanda, Y. et al. (Jul. 5, 2006, e-pub. Apr. 11, 2006). "Comparison of Cell Line for Stable Production of Fucose-Negative Antibodies with Enhanced ADCC," Biotechnol. Bioeng. 94(4):680-688.
Kashmiri, S.V. et al. (2005). "SDR grafting—A New Approach to Antibody Humanization," Methods 36:25-34.
Kim, J-K. et al. (1994). "Localization of the Site of the Murine IgGI Molecule That is Involved in Binding to the Murine Intestinal Fc Receptor," Eur. J. Immunol. 24:2429-2434.
Klimka, A. et al. (2000). "Human Anti-CD30 Recombinant Antibodies by Guided Phage Antibody Selection Using Cell Panning," Br. J. Cancer 83(2):252-260.
Kohler, G. et al. (Aug. 7, 1975) "Continuous Cultures of Fused Cells Secreting Antibody of Predefined Specificity," Nature 256:495-497.

(56) References Cited

OTHER PUBLICATIONS

Kostelny, S.A. et al. (Mar. 1, 1992). "Formation of a Bispecific Antibody by the Use of Leucine Zippers," J. Immunol. 148(5):1547-1553.
Kozbor, D. (Dec. 1984). "A Human Hybrid Myeloma for Production of Human Monoclonal Antibodies," J. Immunol. 133(6):3001-3005.
Lauwereys, M. et al. (Jul. 1, 1998). "Potent Enzyme Inhibitors Derived From Dromedary Heavy-Chain Antibodies," The EMBO Journal 17(13):3512-3520.
Lee, C.V. et al. (2004). "Bivalent Antibody Phage Display Mimics Natural Immunoglobulin," .J. Immunol. Methods 284 (1-2):119-132.
Lee, C.V. et al. (2004). "High-Affinity Human Antibodies From Phage-Displayed Synthetic Fab Libraries With a Single Framework Scaffold," J. Mol. Biol. 340:1073-1093.
Li, A. et al. (Apr. 26, 2016). "A Single-Domain Antibody-Linked Fab Bispecific Antibody Her2-S-Fab has Potent Cytotoxicity Against Her2-Expressing Tumor Cells," AMB Express 6(32):1-8.
Li, J. et al. (Mar. 7, 2006). "Human Antibodies for Immunotherapy Development Generated via a Human B Cell Hybridoma Technology," Proc. Natl. Acad. Sci. USA 103:3557-3562, 6 pages.
Li, L. et al. (Nov./Dec. 2015). "A Novel Bispecific Antibody, S-Fab, Induces Potent Cancer Cell Killing", J. of Immunotherapy 38(9):350-356.
Lindmark, R. et al. (1983). "Binding of Immunoglobulins to Protein A and Immunoglobulin Levels in Mammalian Sera," J. Immunol. Meth. 62:1-13.
Lonberg, N. (Sep. 2005). "Human Antibodies From Transgenic Animals," Nat. Biotech. 23(9):1117-1125.
Lonberg, N. et al. (1995, e-pub. Jul. 10, 2009). "Human Antibodies From Transgenic Mice," Int. Rev. Immunol. 13(1):65-93.
Lonberg, N. et al. (2008, e-pub. Jul. 21, 2008). "Fully Human Antibodies From Transgenic Mouse and Phage Display Platforms," Curr. Opin. Immunol. 20:450-459.
Lonberg, N. et al. (Apr. 28, 1994). "Antigen-Specific Human Antibodies From Mice Comprising Four Distinct Genetic Modifications," Nature 368(6474):856-859.
Marks, J.D. et al. (1991). "By-Passing Immunization Human Antibodies from V-gene Libraries Displayed on Phage," J. Mol. Biol. 222:581-597.
Marks, J.D. et al. (2004) "Selection of Human Antibodies from Phage Display Libraries," Chapter 8 in Methods in Molecular Biology, LO, B.K.C. (ed.), Humana Press Inc., Totowa, NJ, 248:161-176, 29 pages.
Marks, J.D. et al. (Jul. 1992). "By-Passing Immunization: Building High Affinity Human Antibodies by Chain Shuffling," Bio/Technology 10:779-783.
Mather, J.P. (1980). "Establishment and Characterization of Two Distinct Mouse Testicular Epithelial Cell Lines," Biol. Reprod. 23:243-251.
Mather, J.P. et al. (1982). "Culture of Testicular Cells in Hormone-Supplemented Serum-Free Medium," Annals N.Y. Acad. Sci. 383:44-68.
McCafferty, J. et al. (Dec. 6, 1990). "Phage Antibodies: Filamentous Phage Displaying Antibody Variable Domains," Nature 348:552-554.
Milstein, C. et al. (Oct. 6, 1983). "Hybrid Hybridomas and Their Use in Immunohistochemistry," Nature 305:537-539.
Molhoj, M. (Sep. 2011). "Ang2/VEGF CrossMAbCH1-CL, a novel bispecific monovalent human IgGl format aiming at neutralizing Ang2 and VEGF-A to treat solid tumors", Presentations Outline in CrossMAB Technology, 35 pages.
Mordenti, J. et al. (1989). "The Use of Interspecies Scaling in Toxicokinetics," Chapter 4 in Toxicokinetics and New Drug Development, Yacobi A. e.d et al.; Pergamon Press, New York, pp. 42-96.
Morimoto, K. et al. (1992). "Single-Step Purification of F(AB')2 Fragments of Mouse Monoclonal Antibodies (Immunoglobulins G1) by Hydrophobic Interaction High Performance Liquid Chromatography Using TSKgel Phenyl-5PW,"J. Biochem. Biophys. Method 24:107-117.
Morrison, S.C. et al. (Nov. 1984). "Chimeric Human Antibody Molecules: Mouse Antigen-Binding Domains With Human Constant Region Domains," Proc. Natl. Acad. Sci. USA 81:6851-6855.
Morrison, S.L. (Apr. 28, 1994). "Success in Specification," Nature 368:812-813.
Munson, P.J. et al. (1980). "Ligand: A Versatile Computerize Approach for Characterization of Ligand-Binding Systems," Anal. Biochem. 107:220-239.
Murata, K.Y. (Aug. 1999). "Expression of the Costimulatory Molecule BB-1, the Ligands CTLA-4 and CD28, and their mRNA in Inflammatory Myopathies," Am. J. Pathol. 155(2):453-460.
Neuberger, M. (Jul. 1996) "Generating High-Avidity Human Mabs in Mice," Nature Biotechnology 14:826, 1 page.
Ni, J. (Oct. 23, 2006). "Research Progress and Future Perspectives in Antibodmics and Antibodomic Drugs," J. General Review 26(4):265-268, 3 pages.
Okazaki, A. et al. (Mar. 5, 2004). "Fucose Depletion From Human IgG1 Oligosaccharide Enhances Binding Enthalpy and Association Rate Between IgG1 and FcγRIIIa," J. Mol. Biol. 336(5):1239-1249.
Osbourn, J. et al. (2005). "From Rodent Regents to Human Therapeutics Using Antibody Guided Selection," Methods 36:61-68.
Padlan, E.D. (1991). "A Possible Procedure for Reducing the Immunogenicity of Antibody Variable Domains While Preserving Their Ligand-Binding Properties," Mol. Immunol. 28(4/5):489-498.
Pardon, E. et al. (Mar. 2014, e-pub. Feb. 27, 2014). "A General Protocol for the Generation of Nanobodies for Structural Biology," Nature Protocol 9(3):674-693, 40 pages.
Perrin, P.J. et al. (Aug. 15, 1996). "CTLA-4 Blockade Enhances Clinical Disease and Cytokine Production During Experimental Allergic Encephalomyelitis," The Journal of Immunology 157(4):1333-1336.
Petkova, S.B. et al. (Oct. 31, 2006). "Enhanced Half-Life of Genetically Engineered Human IgG1 Antibodies in a Humanized FcRn Mouse Model: Potential Application in Humorally Mediated Autoimmune Disease," Int'l. Immunol. 18(12):1759-1769.
Plückthun, A. (1992). "Mono- and Bivalent Antibody Fragments Producted in *Escherichia coli*: Engineering, Folding and Antigen Binding," Immunol. Revs. 130:151-188.
Plückthun, A. (1994) "Antibodies from *Escherichia coli*," Chapter 11 in Handbook of Experimental Pharmacology 113:269-315.
Presta, L.G. (1992). "Antibody Engineering," Current Opinion in Structural Biology 2:593-596.
Presta, L.G. et al. (Oct. 15, 1997). "Humanization of an Anti-Vascular Endothelial Growth Factor Monoclonal Antibody for the Therapy of Solid Tumors and Other Disorders," Cancer Res. 57:4593-4599.
Presta, L.G. et al. (Sep. 1, 1993). "Humanization of an Antibody Directed Against IgE," J. Immunol. 151(5):2623-2632.
Proba, K. et al. (1995). "Functional Antibody Single-chain Fragments From the Cytoplasm of *Escherichia coli* Influence of Thioredoxin Reductase (trxb)," Gene 159(2):203-207.
Queen, C. et al. (Dec. 1989). "A Humanized Antibody That Binds to the Interleukin 2 Receptor," Proc. Natl Acad. Sci. USA 86:10029-10033.
Ramm, K. et al. (Jun. 2, 2000). "The Periplasmic *Escherichia coli* Peptidylprolyl cis,Trans-Isomerase FkpA," The Journal of Biological Chemistry 275(22):17106-17113.
Ravetch, J.V. et al. (1991). "Fc Receptors," Annu. Rev. Immunol. 9:457-492.
Reyes, G.R. et al. (Jun. 17, 1982) "Expression of Human β-interferon cDNA Under the Control of a Thymidine Kinase Promoter from Herpes Simplex Virus," Nature 297:598-601.
Riechmann, L. (Jun. 28, 1996). "Rearrangement of the Former VL Interface in the Solution Structure of a Camelised, Single Antibody VH Domain," Journal of Molecular Biology 259(5):957-969.
Riechmann, L. et al. (Dec. 10, 1999). "Single Domain Antibodies: Comparison of Camel VH and Camelised Human VH Domains," Journal of Immunological Methods 231(1-2):25-38.
Riechmann, L. et al. (Mar. 1988). "Reshaping Human Antibodies for Therapy," Nature 332:323-329.

(56) References Cited

OTHER PUBLICATIONS

Ripka, J. et al. (Sep. 1986). "Two Chinese Hamster Ovary Glycosylation Mutants Affected in the Conversion of GDP-Mannose to GDP-Fucose," Arch Biochem Biophys. 249(2):533-545.

Rosenberg, S.A. et al. (Dec. 22, 1988). "Use of Tumor-Infiltrating Lymphocytes and Interleukin-2 in the Immunotherapy of Patients With Metastatic Melanoma. A Preliminary Report," N Engl J Med. 319(25):1676-1680.

Rosok, M.J. et al. (Sep. 13, 1996). "A Combinatorial Library Strategy for the Rapid Humanization of Anticarcinoma BR96 Fab," J. Biol. Chem. 271(37):22611-22618.

Schaefer, W. et al. (Jul. 5, 2011) "Immunoglobulin domain crossover as a generic approach for the production of bispecific IgG antibodies," Proc Natl Acad Sci U S A. 108(27):11187-11192.

Schier, R. et al. (1995). "Identification of Functional and Structural Amino-Acid Residues by Parsimonious Mutagenesis," Gene 169:147-155.

Shalaby, M.R. et al. (Jan. 1, 1992). "Development of Humanized Bispecific Antibodies Reactive With Cytotoxic Lymphocytes and Tumor Cells Overexpressing the HER2 Protooncogene, "J. Exp. Med. 175:217-225.

Sheriff, S. et al. (Sep. 1996). "Redefining the Minimal Antigen-Binding Fragment," Nature Struct. Biol. 3 (9):733-736.

Shields, R.L. et al. (Mar. 2, 2001). "High Resolution Mapping of the Binding Site on Human IgG1 for FcγRI, FcγRII. FcγRIII, and FcRn and Design of IgG1 Variants With Improved Binding to the FcγR," J. Biol.Chem. 276(9):6591-6604.

Shinkawa, T. et al. (Jan. 31, 2003). "The Absence of Fucose But Not the Presence of Galactose or Bisecting N-Acetylglucosamine of Human IgG1 Complex-Type Oligosaccharides Shows the Critical Role of Enhancing Antibody-Dependent Cellular Cytotoxicity," Journal of Biological Chemistry 278(5):3466-3473.

Shopes, B. et al. (May 1, 1992). "A Genetically Engineered Human IgG Mutant With Enhanced Cytolytic Activity," J. Imniunol. 148:2918-2922.

Sidhu, S.S. et al. (2004). "Phage-Displayed Antibody Libraries of Synthetic Heavy Chain Complementarity Determining Regions," J. Mol. Biol. 338(2):299-310.

Siebenlist, U. et al. (Jun. 1980). "*E. coli* RNA Polymerase Interacts Homologously With Two Different Promoters," Cell 20(2):269-281.

Simmons, L.C. et al. (May 1, 2002). "Expression of Full-Length Immunoglobulins in *Escherichia coli*: Rapid and Efficient Production of Aglycosylated Antibodies," J. Immunol. Meth. 263(1-2):133-147.

Sims, M.J. et al. (Aug. 15, 1993). "A Humanized CD18 Antibody Can Block Function Without Cell Destruction," J. Immunol. 151:2296-2308.

Skerra, A. (1993) "Bacterial Expression of Immunoglobulin Fragments," Current Opinion in Immunology 5:256-262.

Stamova, S. et al. (Jul. 18, 2012). "Cancer Immunotherapy by Retargeting of Immune Effector Cells via Recombinant Bispecific Antibody Constructs," Antibodies 1(2):172-198.

Stevenson, G.T. et al. (Mar. 1989). "A Chimeric Antibody With Dual Fc Regions (bisFabFc) Prepared by Manipulations at the IgG Hinge," Anti-cancer Drug Des.3(4):219-230.

Streltsov, V.A. (Nov. 2005). "Structure of a Shark Ignar Antibody Variable Domain and Modeling of an Early-Developmental Isotype," Protein Sci. 14:2901-2909.

Suresh, M.R. et al. (1986). "Bispecific Monoclonal Antibodies From Hybrid Hybridomas," Methods in Enzymology 121:210-228, 19 pages.

Transue, T.R. et al. (1998). "Camel Single-Domain Antibody Inhibits Enzyme By Mimicking Carbohydrate Substrate," Proteins 32(4):515-522.

Traunecker, A. et al. (1991). "Bispecific Single Chain Molecules (Janusins) Target Cytotoxic Lymphocytes on HIV Infected Cells," EMBO J. 10(12):3655-3659.

Turnis, M.E. (2012, e-pub. Oct. 1, 2012). "Combinatorial Immunotherapy PD-1 May Not be LAG-ing Behind Any More," Combinatorial Immunotherapy, OncoImmunology 1(7):1172-1174.

Tutt, A. et al. (Jul. 1, 1991) "Trispecific F(ab')3 Derivatives that use Cooperative Signaling Via the TCR/CD3 Complex and CD2 to Activate and Redirect Resting Cytotoxic T Cells," J. Immunol. 147(1):60-69.

Urlaub, G. et al. (Jul. 1980). "Isolation of Chinese Hamster Cell Mutants Deficient in Dihydrofolate Reductase Activity," Proc. Natl. Acad. Sci. USA 77(7):4216-4220.

Van Der Linden, R. (Jun. 23, 2000, e-pub. Jun. 13, 2000). "Induction of Immune Responses and Molecular Cloning of the Heavy Chain Antibody Repertoire of Lama Glama," J. Immunol. Methods 240(1-2):185-195.

Van Dijk, M.A. et al. (Aug. 2001). "Human Antibodies as Next Generation Therapeutics," Curr. Opin. Che. Biology 5(4):368-374.

Vaswani, S.K. et al. (Aug. 1998) "Humanized Antibodies as Potential Therapeutic Drugs," Annals of Allergy, Asthma, & Immunology 81:105-115.

Verhoeyen, M. et al. (Mar. 25, 1988). "Reshaping Human Antibodies: Grafting an Antilysozyme Activity," Science 239(4857):1534-1536.

Vollmers, H.P. et al. (2005) "Death by Stress: Natural IgM-induced Apoptosis," Methods Find Exp Clin Pharmacol. 27(3):1-7.

Vollmers, H.P. et al. (2005). "The 'Early Birds': Natural IgM Antibodies and Immune Surveillance," Histology and Histopathology, 20(3):927-937.

Walunas, T.L. et al. (Jun. 1996). "CTLA-4 Ligation Blocks CD28-Dependent T Cell Activation," The Journal of Experimental Medicine 183(6):2541-2550.

Ward, E.S. et al. (Oct. 12, 1989). "Binding Activities of a Repertoire of Single Immunoglobulin Variable Domains Secreted From *Escherichia coli*," Nature 341(6242): 544-546.

Waterhouse, P. et al. (1993). "Combinatorial Infection and in Vivo Recombination: A Strategy for Making Large Phage Antibody Repertoires," Nucleic Acids Research 21 (9):2265-2266.

Weidle, U.H. et al. (Jan.-Feb. 2013). "The Intriguing Options of Multispecific Antibody Formats for Treatment of Cancer," Cancer Genomics Proteomics 10(1):1-18.

Weidner K. M. et al. (Nov. 1, 2010). "Anti-Angiogenic Activity of a Tetravalent Bispecific Antibody (TAvi6) Targeting VEGF and Angiopoietin-211," Blood 116(21):1746 (abstract 4303), 2 pages.

Wesolowski, J. et al. (Aug. 2009, e-pub. Jun. 16, 2009). "Single Domain Antibodies: Promising Experimental and Therapeutic Tools in Infection and Immunity," Med Microbiol Immunol 198:157-174.

Winter, G. el al. (1994). "Making Antibodies by Phage Display Technology," Ann. Rev. Immunol. 12:433-455.

Wolff, E.A. et al. (Jun. 1, 1993). "Monoclonal Antibody Homodimers: Enhanced Antitumor Activity in Nude Mice," Can Res 53:2560-2565.

Wright, A. et al. (Jan. 1997). "Effect of Glycosylation on Antibody Function: Implications for Genetics Engineering," Trends Biotechnol. 15:26-32.

Written Opinion of the International Searching Authority dated Apr. 12, 2017, for PCT Patent Application No. PCT/CN2016/090703, filed Jul. 20, 2016, 5 pages.

Written Opinion of the International Searching Authority dated Jan. 19, 2018, for PCT Patent Application No. PCT/CN2017/105506, filed Oct. 10, 2017, 6 pages.

Written Opinion of the International Searching Authority dated Jul. 11, 2017, for PCT Patent Application No. PCT/CN2016/101777, filed Oct. 11, 2016, 7 pages.

Written Opinion of the International Searching Authority dated Oct. 11, 2017, for PCT Patent Application No. PCT/CN2017/093644, filed Jul. 20, 2017, 5 pages.

Xu, J.L. et al. (Jul. 2000). "Diversity in the CDR3 Region of VH is Sufficient for Most Antibody Specificities," Immunity 13:37-45.

Yamane-Ohnuki, N. et al. (2004, e-pub. Aug. 6, 2004). "Establishment of FUT8 Knockout Chinese hamster Ovary Cells: An Ideal Host Cell Line for Producing Completely Defucosylated Antibodies With Enhances Antibody-Dependent Cellular Cytotoxicity," Biotech. Bioeng. 87:614-622.

Yaniv, M. (May 6, 1982). "Enhancing Elements for Activation of Eukaryotic Promoters," Nature 297:17-18.

(56) References Cited

OTHER PUBLICATIONS

Yansura, D.G. et al. (1992). "Nucleotide Sequence Selection for Increased Expression of Heterologous Genes in *Escherichia coli*," Methods: A Companion to Methods in Enzymol 4:151-158.

Yelton, D.E. et al. (1995). "Affinity Maturation of the BR96 Anti-Carcinoma Antibody by Codon-Based Mutagenesis," J. Immunol. 155:1994-2004.

Zapata, G. et al. (1995). "Engineering Linear F(ab')2 Fragments for Efficient Production in *Escherichia coli* and Enhanced Antiproliferative Activity," Protein Engineering 8(10):1057-1062.

Zhu, Z. et al. (1997). "Remodeling Domain Interfaces to Enhance Heterodimer Formation," Protein Science 6:781-788.

Anderson, A. C. et al. (May 17, 2016). "Lag-3, Tim-3, and TIGIT: Co-Inhibitory Receptors with Specialized Functions in Immune Regulation," Immunity 44(5):989-1004.

Fromentin, R. et al. (Jul. 14, 2016). "CD4+ T Cells Expressing PD-1, TIGIT and LAG-3 Contribute to HIV Persistence during Art," PLOS Athogens 12(7):1-19.

International Preliminary Report on Patentability dated Jul. 14, 2020, for PCT Patent Application No. PCT/CN2019/070873, filed Jan. 8, 2019, 7 pages.

International Search Report and Written Opinion dated Apr. 11, 2019, for PCT Patent Application No. PCT/CN2019/070873, filed Jan. 8, 2019, 15 pages.

Mabry, R. et al. (2010, e-pub. Dec. 18, 2009). "Engineering of Stable Bispecific Antibodies Targeting IL-17A and IL-23," Protein Engineering, Design & Selection 23(3):115-127.

U.S. Appl. No. 16/960,521, filed Jul. 7, 2020, by Zhang et al.(U.S. Patent Application document is not submitted herewith pursuant to the waiver of 37 C.F.R. § 1.98(a)(2)(iii) issued by the Office on Sep. 21, 2004.).

* cited by examiner

| | A34311 sdAb | A36566 sdAb | A36922 sdAb | Yervoy |
|---|---|---|---|---|
| $IC_{50}$ (nM) | 14.52 | 246 | 29.03 | 5.921 |

| | A34311 HCAb | A36566 HCAb | A36922 HCAb | Yervoy |
|---|---|---|---|---|
| $IC_{50}$ (nM) | 6.864 | 6.599 | 14.08 | 5.921 |

| | Yervoy (Plate 1) | A343111 HCAb | A36566 HCAb | A36922 HCAb | A34313 HCAb |
|---|---|---|---|---|---|
| $EC_{50}$ nM | 12.407 | 10.153 | 11.143 | 11.307 | 12.522 |

FIG. 6

(SEQ ID NO: 200) A34311-direct grafted (1) QVQLVESGGGVVQPGRSLRLSCAASGRTTTTTTMGWFRQAPGKGLEWVASHSWTDNNPY
(SEQ ID NO: 114) A34311-WT (1) QVKLEESGGGIVLEGSSLRLSCEASGRTTTTTTMGWFRQAPGKERFVASHSWTDNNPY
(SEQ ID NO: 201) AS02635 (1) QVQLVESGGGVVQPGRSLRLSCAASGRTTTTTTMGWFRQAPGKGRFVASHSWTDNNPY
(SEQ ID NO: 202) AS02626 (1) QVQLVESGGGVVQPGRSLRLSCAASGRTTTTTTMGWFRQAPGKGIRFVASHSWTDNNPY
(SEQ ID NO: 129) AS02640 (1) QVQLVESGGGVVQPGRSLRLSCAASGRTTTTTTMGWFRQAPGKGREFVASHSWTDNNPY
(SEQ ID NO: 202) Consensus (1) QVQLVESGGGVVQPGRSLRLSCAASGRTTTTTTMGWFRQAPGKGREFVASHSWTDNNPY (SEQ ID NO: 200) A34311-direct grafted (1) YADSVKGRFTISRDNSRNTLYLQMNSLRAEDTAVYYCAKTARRSFVGRQWYTEARQYIDYWGQGTLVTVSS
(SEQ ID NO: 114) A34311-WT (1) YADSVKGRFTISRDNAGNRVYLQMGSLEPEDTAVYYCAATARRSFVGRQWYTEARQYIDYWGQGTQVTVSS
(SEQ ID NO: 201) AS02635 (1) YADSVKGRFTISRDNSKNTLYLQMNSLRAEDTAVYYCAATARRSFVGRQWYTEARQYIDYWGQGTLVTVSS
(SEQ ID NO: 202) AS02626 (1) YADSVKGRFTISRDNSKNRLYLQMNSLRAEDTAVYYCAATARRSFVGRQWYTEARQYIDYWGQGTLVTVSS
(SEQ ID NO: 129) AS02640 (1) YADSVKGRFTISRDNSKNRLYLQMNSLRAEDTAVYYCAATARRSFVGRQWYTEARQYIDYWGQGTLVTVSS
(SEQ ID NO: 202) Consensus (1) YADSVKGRFTISRDNSKNRLYLQMNSLRAEDTAVYYCAATARRSFVGRQWYTEARQYIDYWGQGTLVTVSS

|  | A343111 sdAb | AS02640 sdAb |
|---|---|---|
| $IC_{50}$ nM | 155.6 | 207.2 |

FIG. 8
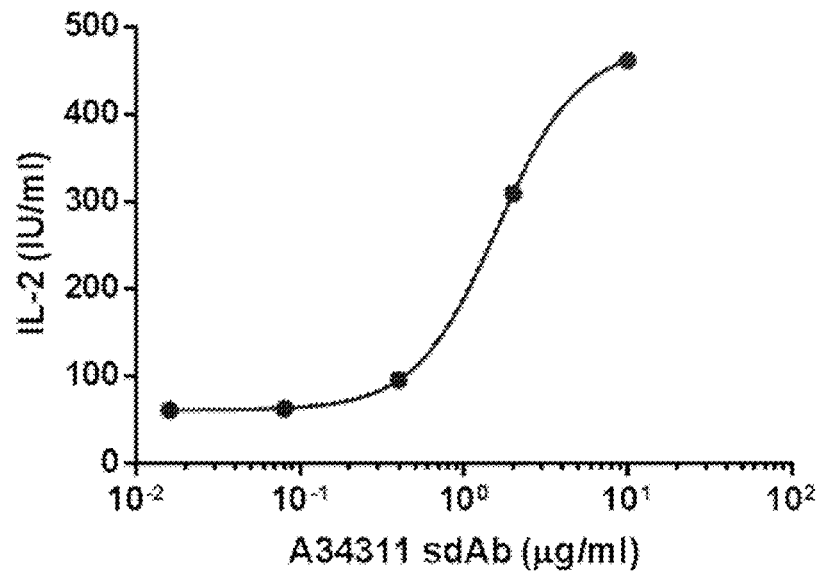
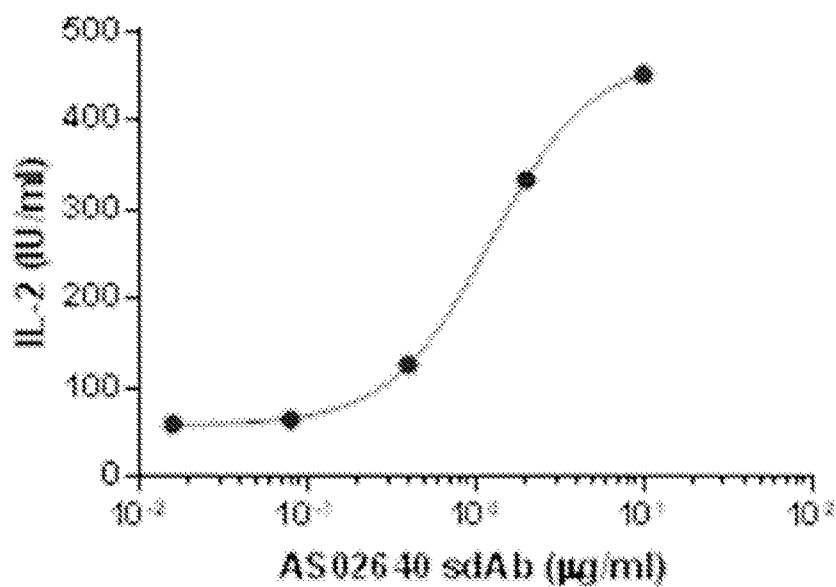
|        | A343111 sdAb | AS02640 sdAb |
|--------|--------------|--------------|
| $EC_{50}$ nM | 106 | 80.7 |

| Analyte | Ligand | $k_a$ (1/Ms) | $k_d$ (1/s) | $K_D$ (M) | Rmax (RU) | Chi² (RU²) | U-value |
|---|---|---|---|---|---|---|---|
| A34311 sdAb | CTLA-4/Fc | 5.91E+05 | 2.93E-03 | 4.96E-09 | 48.79 | 0.0472 | 1 |
| AS02640 sdAb | | 1.29E+06 | 3.81E-03 | 2.95E-09 | 50.12 | 0.177 | 1 |

|  | Yervoy | A343111 HCAb | AS02640 HCAb |
|---|---|---|---|
| $EC_{50}$ nM | 12.65 | 6.76 | 7.25 |

| Ligand | Analyte | $k_a$ (1/Ms) | $k_d$ (1/s) | $K_D$ (M) |
|---|---|---|---|---|
| BCP-311K | | 1.82E+05 | 0.00202 | 1.11E-08 |
| BCP-K311 | PD1-His | 3.11E+05 | 0.002371 | 7.63E-09 |
| Keytruda | | 2.42E+05 | 0.002206 | 9.11E-09 |

FIG. 13E

| Ligand | Analyte | $k_a$ (1/Ms) | $k_d$ (1/s) | $K_D$ (M) |
|---|---|---|---|---|
| BCP-311K | CTLA4-His | 1.02E+05 | 0.001322 | 1.30E-08 |
| BCP-K311 | | 7.45E+04 | 0.002114 | 2.84E-08 |
| A34311 HCAb | | 8.63E+04 | 0.001298 | 1.50E-08 |
| Yervoy | | 8.08E+04 | 0.001398 | 1.73E-08 |

|  | BCP-311K | BCP-K311 | A34311 HCAb | Yervoy |
|---|---|---|---|---|
| $EC_{50}$ nM | 41.85 | 26.64 | 19.76 | 26.10 |

|  | Yervoy biosimilar | BCP-311K | BCP-K311 | A34311 HCAb | Yervoy® |
|---|---|---|---|---|---|
| $EC_{50}$ nM | 10.95 | 10.1 | 10.87 | 8.07 | 9.82 |

|  | Keytruda | BCP-311K | BCP-K311 |
|---|---|---|---|
| $EC_{50}$ nM | 1.57 | 2.81 | 6.72 |

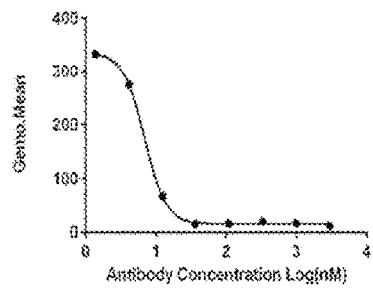
FIG. 18A A34311_HCAb
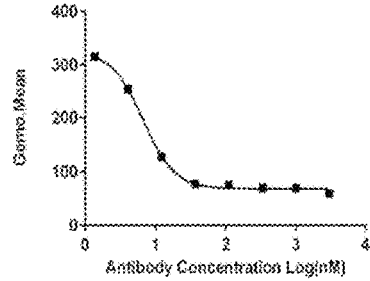
FIG. 18B A36566_HCAb
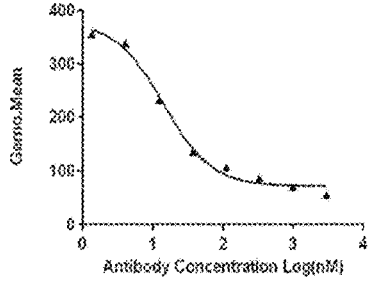
FIG. 18C A36922_HCAb
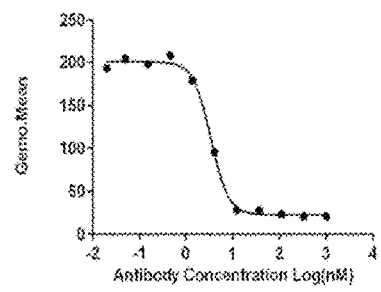
FIG. 18D A34311VH11_HCAb
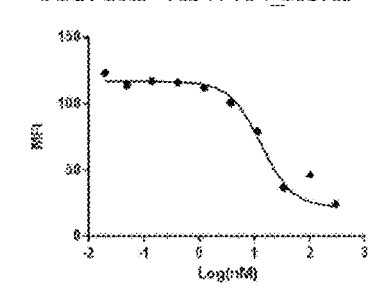
FIG. 18E AS07014_HCAb
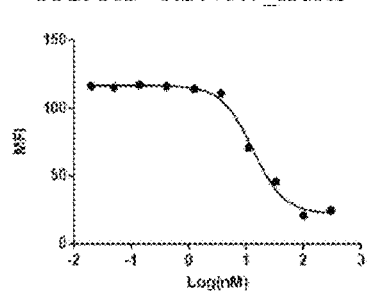
FIG. 18F AS07189_HCAb
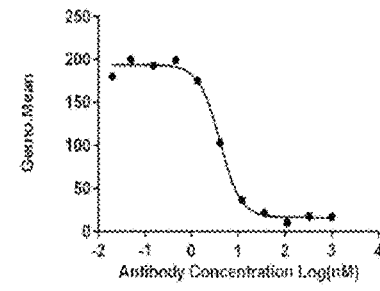
FIG. 18G AS07014VH11_HCAb
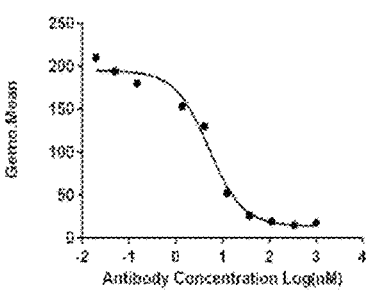
FIG. 18H AS07189TKDVH11_HCAb
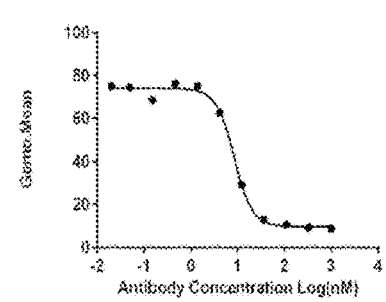
FIG. 18I Yervoy®
FIG. 18J
| | A34311_HCAb | A36566_HCAb | A36922_HCAb | A34311VH11_HCAb | AS07014_HCAb | AS07189_HCAb | AS07014VH11_HCAb | AS07189TKDVH11_HCAb | Yervoy |
|---|---|---|---|---|---|---|---|---|---|
| IC$_{50}$ (nM) | 6.9 | 6.6 | 14.1 | 3.5 | 12.3 | 11.9 | 4.1 | 5.1 | 8.5 |

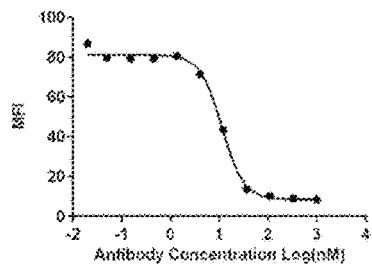
FIG. 19A  BCP-73
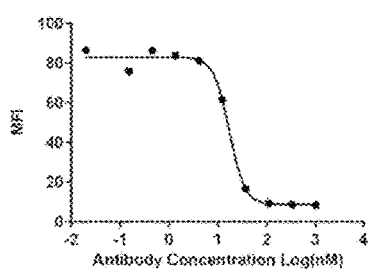
FIG. 19B  BCP-74
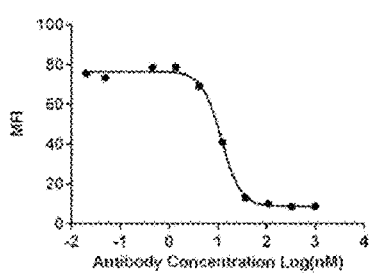
FIG. 19C  BCP-75
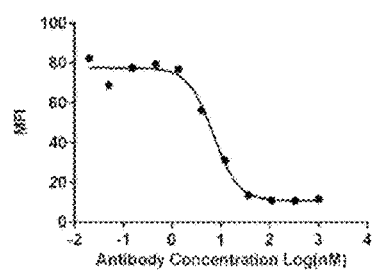
FIG. 19D  BCP-78
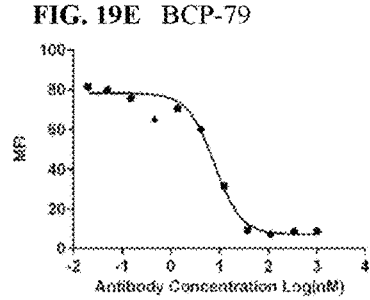
FIG. 19E  BCP-79
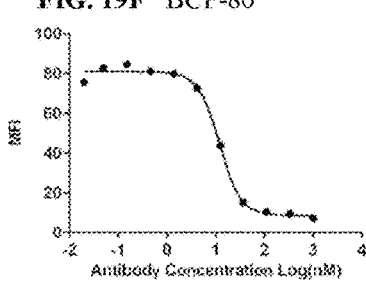
FIG. 19F  BCP-80
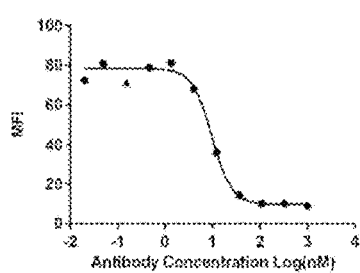
FIG. 19G  BCP-83
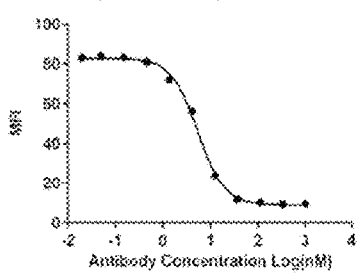
FIG. 19H  BCP-84
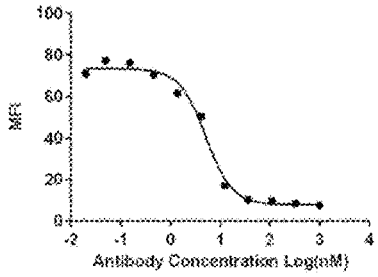
FIG. 19I  BCP-85
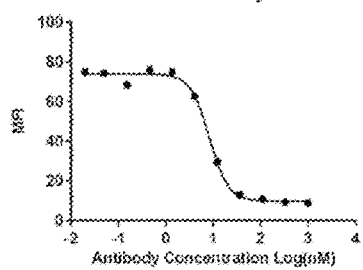
FIG. 19J  Yervoy®
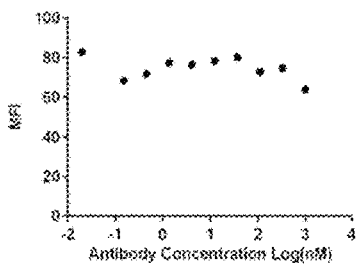
FIG. 19K  Human IgG
FIG. 19L
|  | BCP-73 | BCP-74 | BCP-75 | BCP-78 | BCP-79 | BCP-80 | BCP-83 | BCP-84 | BCP-85 | Yervoy |
|---|---|---|---|---|---|---|---|---|---|---|
| $IC_{50}$ (nM) | 11.5 | 17.2 | 11.7 | 7.1 | 7.8 | 11.9 | 9.9 | 5.5 | 5.1 | 8.5 |

FIG. 20A BCP-73
FIG. 20B BCP-74
FIG. 20C BCP-75
FIG. 20D BCP-78
FIG. 20E BCP-79
FIG. 20F BCP-80
FIG. 20G Opdivo
FIG. 20H Keytruda
FIG. 20I Human IgG

|  | BCP-73 | BCP-74 | BCP-75 | BCP-78 | BCP-79 | BCP-80 | Opdivo | Keytruda |
|---|---|---|---|---|---|---|---|---|
| $IC_{50}$ (nM) | 1.1 | 2.6 | 1.5 | 4.8 | 3.5 | 5.7 | 3.1 | 1.3 |

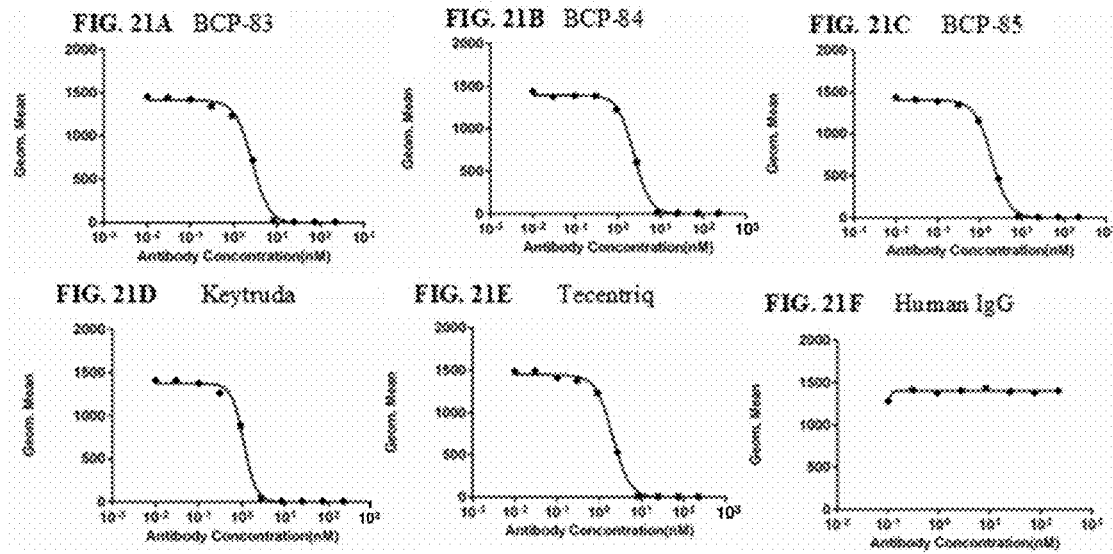
FIG. 21G
|  | BCP-83 | BCP-84 | BCP-85 | Tecentriq | Keytruda |
|---|---|---|---|---|---|
| IC$_{50}$ (nM) | 2.7 | 2.4 | 2.0 | 2.1 | 1.1 |
FIG. 22A
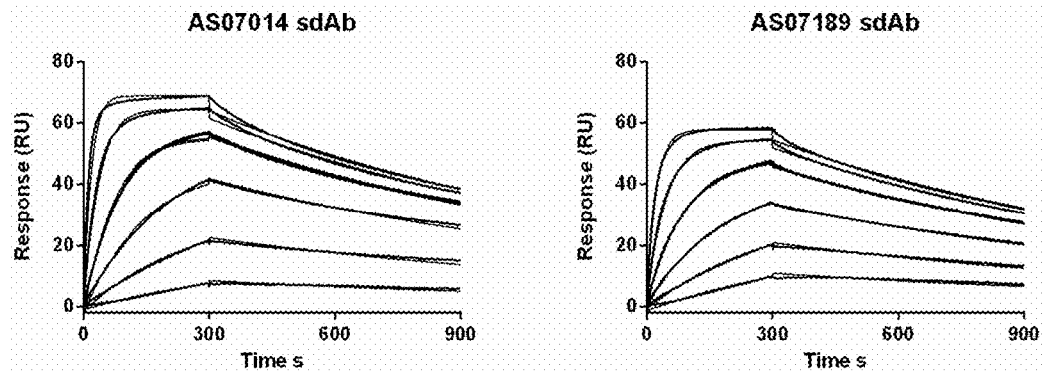
FIG. 22B
| Analyte | Ligand | $k_a$ (1/Ms) | $k_d$ (1/s) | $K_D$ (M) |
|---|---|---|---|---|
| AS07014 sdAb | CTLA-4-His | 1.61E+06 | 9.37E-04 | 5.82E-10 |
| AS07189 sdAb |  | 1.16E+06 | 9.10E-04 | 7.87E-10 |

FIG. 23B

| Analyte | Ligand | $k_a$ (1/Ms) | $k_d$ (1/s) | $K_D$ (M) |
|---|---|---|---|---|
| A34311VH11_HCAb | CTLA-4-His | 6.1E+04 | 9.1E-04 | 1.5E-08 |
| AS07014_HCAb | | 1.7E+05 | 1.9E-04 | 1.1E-09 |
| AS07014VH11_HCAb | | 1.4E+05 | 5.4E-04 | 3.8E-09 |
| AS07014VH11G54_HCAb | | 1.4E+05 | 8.1E-04 | 5.8E-09 |
| AS07014VH11SGA_HCAb | | 6.6E+04 | 7.4E-04 | 1.1E-08 |
| AS07014VH11SGQ_HCAb | | 6.7E+04 | 7.3E-04 | 1.1E-08 |
| AS07014VH11SGS_HCAb | | 6.6E+04 | 7.9E-04 | 1.2E-08 |
| AS07189_HCAb | | 9.9E+04 | 3.0E-04 | 3.0E-09 |
| AS07189TKDVH11_HCAb | | 9.7E+04 | 5.5E-04 | 5.7E-09 |
| AS07189TKDVH11F27_HCAb | | 8.0E+04 | 3.5E-04 | 4.3E-09 |
| AS07189TKDVH11FY_HCAb | | 7.7E+04 | 5.6E-04 | 7.3E-09 |

FIG. 24B

| Ligand | Analyte | $k_a$ (1/Ms) | $k_d$ (1/s) | $K_D$ (M) |
|---|---|---|---|---|
| BCP-73 | CTLA-4-His | 4.8E+04 | 3.6E-04 | 7.5E-09 |
| BCP-74 | | 1.7E+05 | 4.4E-04 | 2.6E-09 |
| BCP-75 | | 1.3E+05 | 5.0E-04 | 4.0E-09 |
| BCP-78 | | 4.8E+04 | 3.1E-04 | 6.6E-09 |
| BCP-79 | | 1.5E+05 | 3.8E-04 | 2.5E-09 |
| BCP-80 | | 9.2E+04 | 5.1E-04 | 5.6E-09 |
| BCP-83 | | 4.6E+04 | 3.5E-04 | 7.6E-09 |
| BCP-84 | | 1.2E+05 | 4.9E-04 | 4.1E-09 |
| BCP-85 | | 9.2E+04 | 3.3E-04 | 3.6E-09 |
| BCP-311K | | 1.0E+05 | 1.3E-03 | 1.3E-08 |
| BCP-K311 | | 7.5E+04 | 2.1E-03 | 2.8E-08 |
| Yervoy | | 8.8E+05 | 1.4E-03 | 1.7E-8 |

| Ligand | Analyte | $k_a$ (1/Ms) | $k_d$ (1/s) | $K_D$ (M) |
|---|---|---|---|---|
| BCP-73 | PD-1-His | 2.80E+05 | 2.10E-03 | 7.50E-09 |
| BCP-74 | | 4.30E+05 | 1.10E-03 | 2.50E-09 |
| BCP-75 | | 5.00E+05 | 1.10E-03 | 2.20E-09 |
| BCP-78 | | 1.90E+05 | 1.60E-03 | 8.10E-09 |
| BCP-79 | | 2.50E+05 | 1.70E-03 | 6.80E-09 |
| BCP-80 | | 3.30E+05 | 2.10E-03 | 6.30E-09 |
| Keytruda | | 3.40E+05 | 2.20E-03 | 6.50E-09 |
| Opdivo | | 2.10E+05 | 1.50E-03 | 7.30E-09 |

| Ligand | Analyte | $k_a$ (1/Ms) | $k_d$ (1/s) | $K_D$ (M) |
|---|---|---|---|---|
| BCP-83 | PD-L1-His | 2.10E+05 | 2.00E-04 | 9.30E-10 |
| BCP-84 | | 2.70E+05 | 1.60E-04 | 6.00E-10 |
| BCP-85 | | 3.40E+05 | 1.70E-04 | 4.90E-10 |
| Tecentriq | | 3.90E+05 | 1.50E-04 | 3.80E-10 |

FIG. 27A
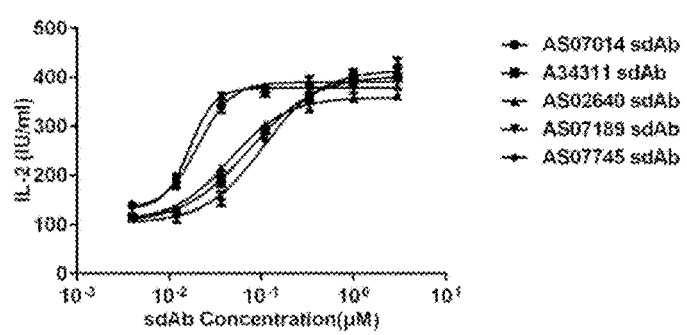
FIG. 27B
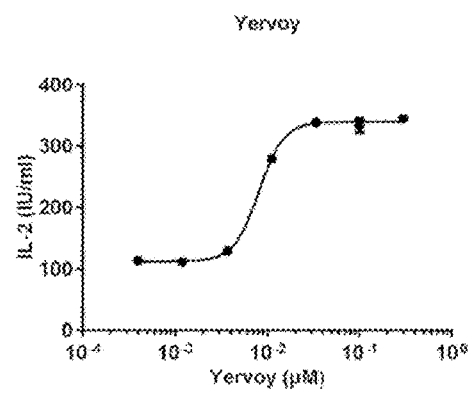
FIG. 27C
|  | AS07014 sdAb | A34311 sdAb | AS02640 sdAb | AS07189 sdAb | AS07745 sdAb | Yervoy |
|---|---|---|---|---|---|---|
| $EC_{50}$(nM) | 20.9 | 75.5 | 47.0 | 16.8 | 10.7 | 8.1 |

FIG. 28B

|  | $EC_{50}$ (nM) |
|---|---|
| A34311_HCAb | 7.9 |
| AS07014_HCAb | 6.5 |
| AS07189_HCAb | 6.7 |
| A34311VH11_HCAb | 16.1 |
| AS07014VH11_HCAb | 12.5 |
| AS07014VH11G54_HCAb | 14.2 |
| AS07014VH11SGQ_HCAb | 11.9 |
| AS07189TKDVH11_HCAb | 10.5 |
| AS07189TKDVH11FY_HCAb | 16.5 |
| Yervoy | 13.4 |

|  | BCP-73 | BCP-74 | BCP-75 | BCP-78 | BCP-79 |
|---|---|---|---|---|---|
| $EC_{50}$ (nM) | 12.1 | 14.3 | 12.1 | 8.4 | 10.9 |
|  | BCP-80 | BCP-83 | BCP-84 | BCP-85 | Yervoy |
| $EC_{50}$ (nM) | 7.4 | 15.8 | 12.8 | 9.7 | 7.1 |

|  | BCP-73 | BCP-74 | BCP-75 | BCP-78 | BCP-79 | BCP-80 | BCP-83 | BCP-84 | BCP-85 | Keytruda | Opdivo | Tecentriq |
|---|---|---|---|---|---|---|---|---|---|---|---|---|
| $EC_{50}$ (nM) | 1.1 | 2.1 | 1.7 | 4.2 | 5.9 | 6.3 | 3.3 | 3.3 | 2.7 | 1.0 | 3.0 | 3.7 |

FIG. 31A    A34311 humanized clones sequences alignments

```
                                     1                                                          50
(SEQ ID NO: 114)    A34311-WT           (1) QVKLEESGGGLVQPGESLRLSCAASGRTITTITMGWFRQAPGKQFVASHSWTDNNPY
(SEQ ID NO: 200) A34311-direct grafted  (1) QVQLVESGGGVVQPGRSLRLSCAASGRTITTITMGWFRQAPGKGLEWVASHSWTDNNPY
(SEQ ID NO: 129)    AS02640             (1) QVQLVESGGGVVQPGRSLRLSCAASGRTITTITMGWFRQAPGKGLEFVASHSWTDNNPY
(SEQ ID NO: 265)    A34311VH11          (1) EVQLVESGGGVVQPGRSLRLSCAASGRTITTITMGWFRQAPGKGLEFVASHSWTDNNPY
(SEQ ID NO: 344)    A34311VH11F53       (1) EVQLVESGGGVVQPGRSLRLSCAASGRTITTITMGWFRQAPGKGLEFVASHSFTDNNPY
(SEQ ID NO: 342)    A34311VH2           (1) EVQLVESGGGVVQPGRSLRLSCAASGRTITTITMGWFRQAPGKGLEFVASHSWTDNNPY
(SEQ ID NO: 343)    A34311VH2F53        (1) EVQLVESGGGVVQPGRSLRLSCAASGRTITTITMGWFRQAPGKGLEFVASHSFTDNNPY
(SEQ ID NO: 372)    Consensus           (1) EVQLVESGGGVVQPGRSLRLSCAASGRTITTITMGWFRQAPGKGLEFVASHSWTDNNPY 60                                                        129
(SEQ ID NO: 114)    A34311-WT           (1) YADSVKGRFTISRDNAKNVYLQMHSLEPEDTAVYYCAATARRSFVGRQWYTEARQYDYWGQGTQVTVSS
(SEQ ID NO: 200) A34311-direct grafted  (1) YADSVKGRFTISRDNSKNTLYLQMNSLRAEDTAVYYCAATARRSFVGRQWYTEARQYDYWGQGTLVTVSS
(SEQ ID NO: 129)    AS02640             (1) YADSVKGRFTISRDNSKNMLYLQMNSLRAEDTAVYYCAATARRSFVGRQWYTEARQYDYWGQGTLVTVSS
(SEQ ID NO: 265)    A34311VH11          (1) YADSVKGRFTISRDNAKNTIYLQMNSLRPEDTAVYYCAATARRSFVGRQWYTEARQYDYWGQGTLVTVSS
(SEQ ID NO: 344)    A34311VH11F53       (1) YADSVKGRFTISRDNAKNTIYLQMNSLRPEDTAVYYCAATARRSFVGRQWYTEARQYDYWGQGTLVTVSS
(SEQ ID NO: 342)    A34311VH2           (1) YADSVKGRFTISRDNSKNTLYLQMNSLRAEDTAVYYCAATARRSFVGRQWYTEARQYDYWGQGTLVTVSS
(SEQ ID NO: 343)    A34311VH2F53        (1) YADSVKGRFTISRDNSKNTLYLQMNSLRAEDTAVYYCAATARRSFVGRQWYTEARQYDYWGQGTLVTVSS
(SEQ ID NO: 372)    Consensus           (1) YADSVKGRFTISRDNSKNTLYLQMNSLRAEDTAVYYCAATARRSFVGRQWYTEARQYDYWGQGTLVTVSS
```

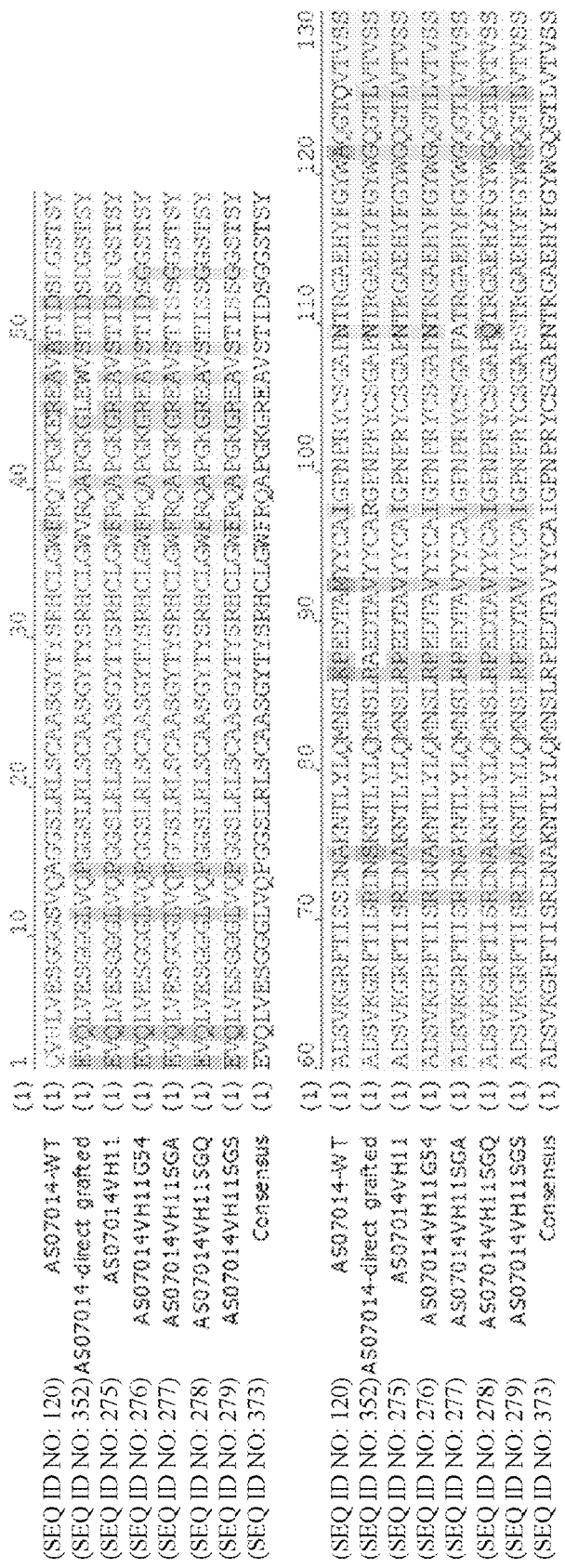
FIG. 31B  AS07014 humanized clones sequences alignments

FIG. 31C  AS07189 humanized clones sequences alignments

```
                                          1         10        20        30        40
(SEQ ID NO: 122) AS07189-WT              (1) QVQLVESGGGVQAGGSLRLSCAASGDSPSVNYMGWFRRAPEKQRE
(SEQ ID NO: 353) AS07189-direct grafted  (1) EVQLVESGGGLVQPGGSLRLSCAASGDSPSVNYMGWVRQAPGKGLE
(SEQ ID NO: 280) AS07189TKDVH11          (1) EVQLVESGGGLVQPGGSLRLSCAASGDSPSVNYMGWFRQAPGKGRE
(SEQ ID NO: 281) AS07189TKDVH11F27       (1) EVQLVESGGGLVQPGGSLRLSCAASGFSPSVNYMGWFRQAPGKGRE
(SEQ ID NO: 282) AS07189TKDVH11FY        (1) EVQLVESGGGLVQPGGSLRLSCAASGFSPSVNYMGWFRQAPGKGRE
(SEQ ID NO: 341) AS07189TKDVH21FY        (1) EVQLVESGGGLVQPGGSLRLSCAASGFSPSVNYMGWVRQAPGKGLE
(SEQ ID NO: 374) Consensus               (1) EVQLVESGGGLVQPGGSLRLSCAASGFSPSVNYMGWFRQAPGKGRE 50        60        70        80        90        100        118
(SEQ ID NO: 122) AS07189-WT              (1) EVASIYPTGGTFYTDSVKGRFTISRDNAKNTLYLQMTALKPEDTAMYCAAGKWGTDYWGQGTQVTVSS
(SEQ ID NO: 353) AS07189-direct grafted  (1) WVSSIYPTGGTFYTDSVKGRFTISRDNSKNTLYLQMNSLRAEDTAVYYCAAGKYGTDYWGQGTLVTVSS
(SEQ ID NO: 280) AS07189TKDVH11          (1) EVSSIYPTGGTFYTDSVKGRFTISRDNAKNTLYLQMNSLRPEDTAVYYCAAGKWGTDYWGQGTLVTVSS
(SEQ ID NO: 281) AS07189TKDVH11F27       (1) EVSSIYPTGGTFYTDSVKGRFTISRDNAKNTLYLQMNSLRPEDTAVYYCAAGKWGTDYWGQGTLVTVSS
(SEQ ID NO: 282) AS07189TKDVH11FY        (1) EVSSIYPTGGTFYTDSVKGRFTISRDNAKNTLYLQMNSLRPEDTAVYYCAAGKYGTDYWGQGTLVTVSS
(SEQ ID NO: 341) AS07189TKDVH21FY        (1) EVSSIYPTGGTFYTDSVKGRFTISRDNSKNTLYLQMNSLRAEDTAVYYCAAGKYGTDYWGQGTLVTVSS
(SEQ ID NO: 374) Consensus               (1) EVSSIYPTGGTFYTDSVKGRFTISRDNAKNTLYLQMNSLRPEDTAVYYCAAGKWGTDYWGQGTLVTVSS
```

FIG. 32B

| HCAb No. | A34311 | AS07014 | AS07189 | AS07745 | A34311VH11 | AS07014VH11 |
|---|---|---|---|---|---|---|
| $EC_{50}$ (nM) | 68.8 | 15.3 | 6.8 | 6 | 3.1 | 4.3 |
| HCAb No. | AS07014VH11SGA | AS07014VH11SGQ | AS07189TKDVH11 | AS07189TKDVH11F27 | AS07189TKDVH11FY | Yervoy |
| $EC_{50}$ (nM) | 2.6 | 2.4 | 4.4 | 4.1 | 3.5 | 4.0 |

|  | BCP-73 | BCP-74 | BCP-75 | BCP-78 | BCP-79 | BCP-80 | BCP-83 | BCP-84 | BCP-85 | Yervoy |
|---|---|---|---|---|---|---|---|---|---|---|
| $EC_{50}$ (nM) | 3.0 | 3.9 | 3.0 | 2.7 | 1.9 | 3.7 | 4.6 | 2.0 | 3.7 | 13.2 |

|  | BCP-73 | BCP-74 | BCP-75 | BCP-78 | BCP-79 | BCP-80 | Opdivo | Keytruda |
|---|---|---|---|---|---|---|---|---|
| $EC_{50}(nM)$ | 2.2 | 1.6 | 1.6 | 1.7 | 1.1 | 1.4 | 1.1 | 2.1 |

|  | BCP-83 | BCP-84 | BCP-85 | Tecentriq |
|---|---|---|---|---|
| $EC_{50}$ (nM) | 3.6 | 3.1 | 3.4 | 3.8 |

SINGLE-DOMAIN ANTIBODIES AND VARIANTS THEREOF AGAINST CTLA-4

RELATED APPLICATIONS

This application is a National Phase application under 35 U.S.C § 371 of International Patent Application No. PCT/CN2017/105506, filed on Oct. 10, 2017, which claims priority benefit from International Patent Application No. PCT/CN2016/101777, filed on Oct. 11, 2016, and International Patent Application No. PCT/CN2017/093644, filed on Jul. 20, 2017, the contents of which are incorporated herein by reference in their entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name 761422000300SEQLIST.txt, date recorded: Apr. 1, 2019, size: 699 KB.

FIELD OF THE INVENTION

The present invention relates to constructs comprising a single-domain antibody (sdAb) moiety that specifically recognizes CTLA-4, and methods of making and using thereof.

BACKGROUND OF THE INVENTION

Activation of T cells requires not only stimulation through the T cell receptor (TCR), but also additional signaling through co-stimulatory surface molecules such as CD28, which is constitutively expressed on T cell surface. The ligands for CD28 are the B7-1 (CD80) and B7-2 (CD86), which are present on antigen-presenting cells (APCs) such as dendritic cells, activated B-cells or monocytes. The interaction between B7 and CD28 is one of the several co-stimulatory signaling pathways that appear to be sufficient to trigger the maturation and proliferation of antigen specific T cells. Lack of co-stimulation, thus concomitant inadequacy of IL-2 production, prevents subsequent T cell proliferation and induces a state of non-reactivity termed "anergy".

Cytotoxic T-Lymphocyte-Associated protein 4 (CTLA-4, or CD152) is a homolog of CD28, and is known as an inhibitory immune checkpoint molecule up-regulated on activated T-cells. CTLA-4 also binds to B7-1 and B7-2, but with greater affinity than CD28. The interaction between B7 and CTLA-4 dampens T cell activation, which constitutes an important mechanism of tumor immune escape. Anti-CTLA-4 antibody therapy has shown promise in a number of cancers, such as melanoma.

Single-chain antibodies (sdAbs) are different from conventional 4-chain antibodies by having a single monomeric antibody variable domain. For example, camelids and sharks produce single-domain antibodies named heavy chain-only antibodies (HCAbs), which naturally lack light chains. The antigen-binding fragment in each arm of the camelid HCAb has a single heavy chain variable domain ($V_HH$), which can exhibit high affinity to an antigen without the aid of a light chain. Camelid $V_HH$ is known as the smallest functional antigen-binding fragment with a molecular weight of approximately 15 kD.

The disclosures of all publications, patents, patent applications and published patent applications referred to herein are hereby incorporated herein by reference in their entirety.

BRIEF SUMMARY OF THE INVENTION

The present invention relates to constructs comprising a single-domain antibody (sdAb) moiety that specifically recognizes CTLA-4, and methods of making and using thereof.

One aspect of the present application provides an isolated anti-CTLA-4 construct comprising a sdAb moiety specifically recognizing CTLA-4, wherein the sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions.

In some embodiments according to any one of the isolated anti-CTLA-4 constructs described above, the sdAb moiety specifically recognizing CTLA-4 comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions.

In some embodiments according to any one of the isolated anti-CTLA-4 constructs described above, the sdAb moiety specifically recognizing CTLA-4 comprises any one of the following:

(1) a CDR1 comprising the amino acid sequence of SEQ ID NO: 17, or a variant thereof comprising up to about 3 (such as about any of 1, 2, or 3) amino acid substitutions; a CDR2 comprising the amino acid sequence of SEQ ID NO: 49, or a variant thereof comprising up to about any of 1, 2, or 3) amino acid substitutions; and a CDR3 comprising the amino acid sequence of SEQ ID NO: 81, or a variant thereof comprising up to about 3 (such as about any of 1, 2, or 3) amino acid substitutions;

(2) a CDR1 comprising the amino acid sequence of SEQ ID NO: 18, or a variant thereof comprising up to about 3 (such as about any of 1, 2, or 3) amino acid substitutions; a CDR2 comprising the amino acid sequence of SEQ ID NO: 50, or a variant thereof comprising up to about any of 1, 2, or 3) amino acid substitutions; and a CDR3 comprising the amino acid sequence of SEQ ID NO: 82, or a variant thereof comprising up to about 3 (such as about any of 1, 2, or 3) amino acid substitutions;

(3) a CDR1 comprising the amino acid sequence of SEQ ID NO: 19, or a variant thereof comprising up to about 3 (such as about any of 1, 2, or 3) amino acid substitutions; a CDR2 comprising the amino acid sequence of SEQ ID NO: 51, or a variant thereof comprising up to about any of 1, 2, or 3) amino acid substitutions; and a CDR3 comprising the amino acid sequence of SEQ ID NO: 83, or a variant thereof comprising up to about 3 (such as about any of 1, 2, or 3) amino acid substitutions;

(4) a CDR1 comprising the amino acid sequence of SEQ ID NO: 20, or a variant thereof comprising up to about 3 (such as about any of 1, 2, or 3) amino acid substitutions; a CDR2 comprising the amino acid sequence of SEQ ID NO: 52, or a variant thereof comprising up to about 3 (such as about any of 1, 2, or 3) amino acid substitutions; and a CDR3 comprising the amino acid sequence of SEQ ID NO: 84, or a variant thereof comprising up to about 3 (such as about any of 1, 2, or 3) amino acid substitutions;

(5) a CDR1 comprising the amino acid sequence of SEQ ID NO: 21, or a variant thereof comprising up to about 3 (such as about any of 1, 2, or 3) amino acid substitutions; a CDR2 comprising the amino acid sequence of SEQ ID NO: 53, or a variant thereof comprising up to about 3 (such as about any of 1, 2, or 3) amino acid substitutions; and a CDR3 comprising the amino acid sequence of SEQ ID NO: 85, or a variant thereof comprising up to about 3 (such as about any of 1, 2, or 3) amino acid substitutions;

(6) a CDR1 comprising the amino acid sequence of SEQ ID NO: 22, or a variant thereof comprising up to about 3 (such as about any of 1, 2, or 3) amino acid substitutions; a CDR2 comprising the amino acid sequence of SEQ ID NO: 54, or a variant thereof comprising up to about 3 (such as about any of 1, 2, or 3) amino acid substitutions; and a CDR3 comprising the amino acid sequence of SEQ ID NO: 86, or a variant thereof comprising up to about 3 (such as about any of 1, 2, or 3) amino acid substitutions;

(7) a CDR1 comprising the amino acid sequence of SEQ ID NO: 23, or a variant thereof comprising up to about 3 (such as about any of 1, 2, or 3) amino acid substitutions; a CDR2 comprising the amino acid sequence of SEQ ID NO: 55, or a variant thereof comprising up to about 3 (such as about any of 1, 2, or 3) amino acid substitutions; and a CDR3 comprising the amino acid sequence of SEQ ID NO: 87, or a variant thereof comprising up to about 3 (such as about any of 1, 2, or 3) amino acid substitutions;

(8) a CDR1 comprising the amino acid sequence of SEQ ID NO: 24, or a variant thereof comprising up to about 3 (such as about any of 1, 2, or 3) amino acid substitutions; a CDR2 comprising the amino acid sequence of SEQ ID NO: 56, or a variant thereof comprising up to about 3 (such as about any of 1, 2, or 3) amino acid substitutions; and a CDR3 comprising the amino acid sequence of SEQ ID NO: 88, or a variant thereof comprising up to about 3 (such as about any of 1, 2, or 3) amino acid substitutions;

(9) a CDR1 comprising the amino acid sequence of SEQ ID NO: 25, or a variant thereof comprising up to about 3 (such as about any of 1, 2, or 3) amino acid substitutions; a CDR2 comprising the amino acid sequence of SEQ ID NO: 57, or a variant thereof comprising up to about 3 (such as about any of 1, 2, or 3) amino acid substitutions; and a CDR3 comprising the amino acid sequence of SEQ ID NO: 89, or a variant thereof comprising up to about 3 (such as about any of 1, 2, or 3) amino acid substitutions;

(10) a CDR1 comprising the amino acid sequence of SEQ ID NO: 26, or a variant thereof comprising up to about 3 (such as about any of 1, 2, or 3) amino acid substitutions; a CDR2 comprising the amino acid sequence of SEQ ID NO: 58, or a variant thereof comprising up to about 3 (such as about any of 1, 2, or 3) amino acid substitutions; and a CDR3 comprising the amino acid sequence of SEQ ID NO: 90, or a variant thereof comprising up to about 3 (such as about any of 1, 2, or 3) amino acid substitutions;

(11) a CDR1 comprising the amino acid sequence of SEQ ID NO: 27, or a variant thereof comprising up to about 3 (such as about any of 1, 2, or 3) amino acid substitutions; a CDR2 comprising the amino acid sequence of SEQ ID NO: 59, or a variant thereof comprising up to about 3 (such as about any of 1, 2, or 3) amino acid substitutions; and a CDR3 comprising the amino acid sequence of SEQ ID NO: 91, or a variant thereof comprising up to about 3 (such as about any of 1, 2, or 3) amino acid substitutions;

(12) a CDR1 comprising the amino acid sequence of SEQ ID NO: 28, or a variant thereof comprising up to about 3 (such as about any of 1, 2, or 3) amino acid substitutions; a CDR2 comprising the amino acid sequence of SEQ ID NO: 60, or a variant thereof comprising up to about 3 (such as about any of 1, 2, or 3) amino acid substitutions; and a CDR3 comprising the amino acid sequence of SEQ ID NO: 92, or a variant thereof comprising up to about 3 (such as about any of 1, 2, or 3) amino acid substitutions;

(13) a CDR1 comprising the amino acid sequence of SEQ ID NO: 29, or a variant thereof comprising up to about 3 (such as about any of 1, 2, or 3) amino acid substitutions; a CDR2 comprising the amino acid sequence of SEQ ID NO: 61, or a variant thereof comprising up to about 3 (such as about any of 1, 2, or 3) amino acid substitutions; and a CDR3 comprising the amino acid sequence of SEQ ID NO: 93, or a variant thereof comprising up to about 3 (such as about any of 1, 2, or 3) amino acid substitutions;

(14) a CDR1 comprising the amino acid sequence of SEQ ID NO: 30, or a variant thereof comprising up to about 3 (such as about any of 1, 2, or 3) amino acid substitutions; a CDR2 comprising the amino acid sequence of SEQ ID NO: 62, or a variant thereof comprising up to about 3 (such as about any of 1, 2, or 3) amino acid substitutions; and a CDR3 comprising the amino acid sequence of SEQ ID NO: 94, or a variant thereof comprising up to about 3 (such as about any of 1, 2, or 3) amino acid substitutions;

(15) a CDR1 comprising the amino acid sequence of SEQ ID NO: 31, or a variant thereof comprising up to about 3 (such as about any of 1, 2, or 3) amino acid substitutions; a CDR2 comprising the amino acid sequence of SEQ ID NO: 63, or a variant thereof comprising up to about 3 (such as about any of 1, 2, or 3) amino acid substitutions; and a CDR3 comprising the amino acid sequence of SEQ ID NO: 95, or a variant thereof comprising up to about 3 (such as about any of 1, 2, or 3) amino acid substitutions;

(16) a CDR1 comprising the amino acid sequence of SEQ ID NO: 32, or a variant thereof comprising up to about 3 (such as about any of 1, 2, or 3) amino acid substitutions; a CDR2 comprising the amino acid sequence of SEQ ID NO: 64, or a variant thereof comprising up to about 3 (such as about any of 1, 2, or 3) amino acid substitutions; and a CDR3 comprising the amino acid sequence of SEQ ID NO: 96, or a variant thereof comprising up to about 3 (such as about any of 1, 2, or 3) amino acid substitutions;

(17) a CDR1 comprising the amino acid sequence of SEQ ID NO: 213, or a variant thereof comprising up to about 3 (such as about any of 1, 2, or 3) amino acid substitutions; a CDR2 comprising the amino acid sequence of SEQ ID NO: 233, or a variant thereof comprising up to about 3 (such as about any of 1, 2, or 3) amino acid substitutions; and a CDR3 comprising the amino acid sequence of SEQ ID NO: 253, or a variant thereof comprising up to about 3 (such as about any of 1, 2, or 3) amino acid substitutions;

(18) a CDR1 comprising the amino acid sequence of SEQ ID NO: 214, or a variant thereof comprising up to about 3 (such as about any of 1, 2, or 3) amino acid substitutions; a CDR2 comprising the amino acid sequence of SEQ ID NO: 234, or a variant thereof comprising up to about 3 (such as about any of 1, 2, or 3) amino acid substitutions; and a CDR3 comprising the amino acid sequence of SEQ ID NO: 254, or a variant thereof comprising up to about 3 (such as about any of 1, 2, or 3) amino acid substitutions;

(19) a CDR1 comprising the amino acid sequence of SEQ ID NO: 215, or a variant thereof comprising up to about 3 (such as about any of 1, 2, or 3) amino acid substitutions; a CDR2 comprising the amino acid sequence of SEQ ID NO: 235, or a variant thereof comprising up to about 3 (such as about any of 1, 2, or 3) amino acid substitutions; and a CDR3 comprising the amino acid sequence of SEQ ID NO: 255, or a variant thereof comprising up to about 3 (such as about any of 1, 2, or 3) amino acid substitutions;

(20) a CDR1 comprising the amino acid sequence of SEQ ID NO: 216, or a variant thereof comprising up to about 3 (such as about any of 1, 2, or 3) amino acid substitutions; a CDR2 comprising the amino acid sequence of SEQ ID NO: 236, or a variant thereof comprising up to about 3 (such as about any of 1, 2, or 3) amino acid substitutions; and a CDR3 comprising the amino acid sequence of SEQ ID NO: 256, or a variant thereof comprising up to about 3 (such as about any of 1, 2, or 3) amino acid substitutions;

(21) a CDR1 comprising the amino acid sequence of SEQ ID NO: 217, or a variant thereof comprising up to about 3 (such as about any of 1, 2, or 3) amino acid substitutions; a CDR2 comprising the amino acid sequence of SEQ ID NO: 237, or a variant thereof comprising up to about 3 (such as about any of 1, 2, or 3) amino acid substitutions; and a CDR3 comprising the amino acid sequence of SEQ ID NO: 257, or a variant thereof comprising up to about 3 (such as about any of 1, 2, or 3) amino acid substitutions;

(22) a CDR1 comprising the amino acid sequence of SEQ ID NO: 218, or a variant thereof comprising up to about 3 (such as about any of 1, 2, or 3) amino acid substitutions; a CDR2 comprising the amino acid sequence of SEQ ID NO: 238, or a variant thereof comprising up to about 3 (such as about any of 1, 2, or 3) amino acid substitutions; and a CDR3 comprising the amino acid sequence of SEQ ID NO: 258, or a variant thereof comprising up to about 3 (such as about any of 1, 2, or 3) amino acid substitutions;

(23) a CDR1 comprising the amino acid sequence of SEQ ID NO: 219, or a variant thereof comprising up to about 3 (such as about any of 1, 2, or 3) amino acid substitutions; a CDR2 comprising the amino acid sequence of SEQ ID NO: 239, or a variant thereof comprising up to about 3 (such as about any of 1, 2, or 3) amino acid substitutions; and a CDR3 comprising the amino acid sequence of SEQ ID NO: 259, or a variant thereof comprising up to about 3 (such as about any of 1, 2, or 3) amino acid substitutions;

(24) a CDR1 comprising the amino acid sequence of SEQ ID NO: 220, or a variant thereof comprising up to about 3 (such as about any of 1, 2, or 3) amino acid substitutions; a CDR2 comprising the amino acid sequence of SEQ ID NO: 240, or a variant thereof comprising up to about 3 (such as about any of 1, 2, or 3) amino acid substitutions; and a CDR3 comprising the amino acid sequence of SEQ ID NO: 260, or a variant thereof comprising up to about 3 (such as about any of 1, 2, or 3) amino acid substitutions;

(25) a CDR1 comprising the amino acid sequence of SEQ ID NO: 221, or a variant thereof comprising up to about 3 (such as about any of 1, 2, or 3) amino acid substitutions; a CDR2 comprising the amino acid sequence of SEQ ID NO: 241, or a variant thereof comprising up to about 3 (such as about any of 1, 2, or 3) amino acid substitutions; and a CDR3 comprising the amino acid sequence of SEQ ID NO: 261, or a variant thereof comprising up to about 3 (such as about any of 1, 2, or 3) amino acid substitutions;

(26) a CDR1 comprising the amino acid sequence of SEQ ID NO: 222, or a variant thereof comprising up to about 3 (such as about any of 1, 2, or 3) amino acid substitutions; a CDR2 comprising the amino acid sequence of SEQ ID NO: 242, or a variant thereof comprising up to about 3 (such as about any of 1, 2, or 3) amino acid substitutions; and a CDR3 comprising the amino acid sequence of SEQ ID NO: 262, or a variant thereof comprising up to about 3 (such as about any of 1, 2, or 3) amino acid substitutions; or

(27) a CDR1 comprising the amino acid sequence of SEQ ID NO: 214, or a variant thereof comprising up to about 3 (such as about any of 1, 2, or 3) amino acid substitutions; a CDR2 comprising the amino acid sequence of SEQ ID NO: 339, or a variant thereof comprising up to about 3 (such as about any of 1, 2, or 3) amino acid substitutions; and a CDR3 comprising the amino acid sequence of SEQ ID NO: 254, or a variant thereof comprising up to about 3 (such as about any of 1, 2, or 3) amino acid substitutions.

In some embodiments according to any one of the isolated anti-CTLA-4 constructs described above, the sdAb moiety specifically recognizing CTLA-4 comprises any one of the following:

(1) a CDR1 comprising the amino acid sequence of SEQ ID NO: 17; a CDR2 comprising the amino acid sequence of SEQ ID NO: 49; and a CDR3 comprising the amino acid sequence of SEQ ID NO: 81; or a variant thereof comprising up to about 3 (such as about any of 1, 2, or 3) amino acid substitutions in the CDR regions;

(2) a CDR1 comprising the amino acid sequence of SEQ ID NO: 18; a CDR2 comprising the amino acid sequence of SEQ ID NO: 50; and a CDR3 comprising the amino acid sequence of SEQ ID NO: 82; or a variant thereof comprising up to about 3 (such as about any of 1, 2, or 3) amino acid substitutions in the CDR regions;

(3) a CDR1 comprising the amino acid sequence of SEQ ID NO: 19; a CDR2 comprising the amino acid sequence of SEQ ID NO: 51; and a CDR3 comprising the amino acid sequence of SEQ ID NO: 83; or a variant thereof comprising up to about 3 (such as about any of 1, 2, or 3) amino acid substitutions in the CDR regions;

(4) a CDR1 comprising the amino acid sequence of SEQ ID NO: 20; a CDR2 comprising the amino acid sequence of SEQ ID NO: 52; and a CDR3 comprising the amino acid sequence of SEQ ID NO: 84; or a variant thereof comprising up to about 3 (such as about any of 1, 2, or 3) amino acid substitutions in the CDR regions;

(5) a CDR1 comprising the amino acid sequence of SEQ ID NO: 21; a CDR2 comprising the amino acid sequence of SEQ ID NO: 53; and a CDR3 comprising the amino acid sequence of SEQ ID NO: 85; or a variant thereof comprising up to about 3 (such as about any of 1, 2, or 3) amino acid substitutions in the CDR regions;

(6) a CDR1 comprising the amino acid sequence of SEQ ID NO: 22; a CDR2 comprising the amino acid sequence of SEQ ID NO: 54; and a CDR3 comprising the amino acid sequence of SEQ ID NO: 86; or a variant thereof comprising up to about 3 (such as about any of 1, 2, or 3) amino acid substitutions in the CDR regions;

(7) a CDR1 comprising the amino acid sequence of SEQ ID NO: 23; a CDR2 comprising the amino acid sequence of SEQ ID NO: 55; and a CDR3 comprising the amino acid sequence of SEQ ID NO: 87; or a variant thereof comprising up to about 3 (such as about any of 1, 2, or 3) amino acid substitutions in the CDR regions;

(8) a CDR1 comprising the amino acid sequence of SEQ ID NO: 24; a CDR2 comprising the amino acid sequence of SEQ ID NO: 56; and a CDR3 comprising the amino acid sequence of SEQ ID NO: 88; or a variant thereof comprising up to about 3 (such as about any of 1, 2, or 3) amino acid substitutions in the CDR regions;

(9) a CDR1 comprising the amino acid sequence of SEQ ID NO: 25; a CDR2 comprising the amino acid sequence of SEQ ID NO: 57; and a CDR3 comprising the amino acid sequence of SEQ ID NO: 89; or a variant thereof comprising up to about 3 (such as about any of 1, 2, or 3) amino acid substitutions in the CDR regions;

(10) a CDR1 comprising the amino acid sequence of SEQ ID NO: 26; a CDR2 comprising the amino acid sequence of SEQ ID NO: 58; and a CDR3 comprising the amino acid sequence of SEQ ID NO: 90; or a variant thereof comprising up to about 3 (such as about any of 1, 2, or 3) amino acid substitutions in the CDR regions;

(11) a CDR1 comprising the amino acid sequence of SEQ ID NO: 27; a CDR2 comprising the amino acid sequence of SEQ ID NO: 59; and a CDR3 comprising the amino acid sequence of SEQ ID NO: 91; or a variant thereof comprising up to about 3 (such as about any of 1, 2, or 3) amino acid substitutions in the CDR regions;

(12) a CDR1 comprising the amino acid sequence of SEQ ID NO: 28; a CDR2 comprising the amino acid sequence of SEQ ID NO: 60; and a CDR3 comprising the amino acid sequence of SEQ ID NO: 92; or a variant thereof comprising up to about 3 (such as about any of 1, 2, or 3) amino acid substitutions in the CDR regions;

(13) a CDR1 comprising the amino acid sequence of SEQ ID NO: 29; a CDR2 comprising the amino acid sequence of SEQ ID NO: 61; and a CDR3 comprising the amino acid sequence of SEQ ID NO: 93; or a variant thereof comprising up to about 3 (such as about any of 1, 2, or 3) amino acid substitutions in the CDR regions;

(14) a CDR1 comprising the amino acid sequence of SEQ ID NO: 30; a CDR2 comprising the amino acid sequence of SEQ ID NO: 62; and a CDR3 comprising the amino acid sequence of SEQ ID NO: 94; or a variant thereof comprising up to about 3 (such as about any of 1, 2, or 3) amino acid substitutions in the CDR regions;

(15) a CDR1 comprising the amino acid sequence of SEQ ID NO: 31; a CDR2 comprising the amino acid sequence of SEQ ID NO: 63; and a CDR3 comprising the amino acid sequence of SEQ ID NO: 95; or a variant thereof comprising up to about 3 (such as about any of 1, 2, or 3) amino acid substitutions in the CDR regions;

(16) a CDR1 comprising the amino acid sequence of SEQ ID NO: 32; a CDR2 comprising the amino acid sequence of SEQ ID NO: 64; and a CDR3 comprising the amino acid sequence of SEQ ID NO: 96; or a variant thereof comprising up to about 3 (such as about any of 1, 2, or 3) amino acid substitutions in the CDR regions;

(17) a CDR1 comprising the amino acid sequence of SEQ ID NO: 213; a CDR2 comprising the amino acid sequence of SEQ ID NO: 233; and a CDR3 comprising the amino acid sequence of SEQ ID NO: 253; or a variant thereof comprising up to about 3 (such as about any of 1, 2, or 3) amino acid substitutions in the CDR regions;

(18) a CDR1 comprising the amino acid sequence of SEQ ID NO: 214; a CDR2 comprising the amino acid sequence of SEQ ID NO: 234; and a CDR3 comprising the amino acid sequence of SEQ ID NO: 254; or a variant thereof comprising up to about 3 (such as about any of 1, 2, or 3) amino acid substitutions in the CDR regions;

(19) a CDR1 comprising the amino acid sequence of SEQ ID NO: 215; a CDR2 comprising the amino acid sequence of SEQ ID NO: 235; and a CDR3 comprising the amino acid sequence of SEQ ID NO: 255; or a variant thereof comprising up to about 3 (such as about any of 1, 2, or 3) amino acid substitutions in the CDR regions;

(20) a CDR1 comprising the amino acid sequence of SEQ ID NO: 216; a CDR2 comprising the amino acid sequence of SEQ ID NO: 236; and a CDR3 comprising the amino acid sequence of SEQ ID NO: 256; or a variant thereof comprising up to about 3 (such as about any of 1, 2, or 3) amino acid substitutions in the CDR regions;

(21) a CDR1 comprising the amino acid sequence of SEQ ID NO: 217; a CDR2 comprising the amino acid sequence of SEQ ID NO: 237; and a CDR3 comprising the amino acid sequence of SEQ ID NO: 257; or a variant thereof comprising up to about 3 (such as about any of 1, 2, or 3) amino acid substitutions in the CDR regions;

(22) a CDR1 comprising the amino acid sequence of SEQ ID NO: 218; a CDR2 comprising the amino acid sequence of SEQ ID NO: 238; and a CDR3 comprising the amino acid sequence of SEQ ID NO: 258; or a variant thereof comprising up to about 3 (such as about any of 1, 2, or 3) amino acid substitutions in the CDR regions;

(23) a CDR1 comprising the amino acid sequence of SEQ ID NO: 219; a CDR2 comprising the amino acid sequence of SEQ ID NO: 239; and a CDR3 comprising the amino acid sequence of SEQ ID NO: 259; or a variant thereof comprising up to about 3 (such as about any of 1, 2, or 3) amino acid substitutions in the CDR regions;

(24) a CDR1 comprising the amino acid sequence of SEQ ID NO: 220; a CDR2 comprising the amino acid sequence of SEQ ID NO: 240; and a CDR3 comprising the amino acid sequence of SEQ ID NO: 260; or a variant thereof comprising up to about 3 (such as about any of 1, 2, or 3) amino acid substitutions in the CDR regions;

(25) a CDR1 comprising the amino acid sequence of SEQ ID NO: 221; a CDR2 comprising the amino acid sequence of SEQ ID NO: 241; and a CDR3 comprising the amino acid sequence of SEQ ID NO: 261; or a variant thereof comprising up to about 3 (such as about any of 1, 2, or 3) amino acid substitutions in the CDR regions;

(26) a CDR1 comprising the amino acid sequence of SEQ ID NO: 222; a CDR2 comprising the amino acid sequence of SEQ ID NO: 242; and a CDR3 comprising the amino acid sequence of SEQ ID NO: 262; or a variant thereof comprising up to about 3 (such as about any of 1, 2, or 3) amino acid substitutions in the CDR regions; or

(27) a CDR1 comprising the amino acid sequence of SEQ ID NO: 214; a CDR2 comprising the amino acid sequence of SEQ ID NO: 339; and a CDR3 comprising the amino acid sequence of SEQ ID NO: 254; or a variant thereof comprising up to about 3 (such as about any of 1, 2, or 3) amino acid substitutions in the CDR regions.

In some embodiments according to any one of the isolated anti-CTLA-4 constructs described above, the sdAb moiety specifically recognizing CTLA-4 comprises a $V_H H$ domain comprising the amino acid sequence of any one of the following: a-1) the amino acid residue at position 37 is selected from the group consisting of F, Y, V, L, A, H, S, I, W, C, N, G, D, T, and P (such as F, Y, L, I, or V, such as F or Y, or such as F); a-2) the amino acid residue at position 44 is selected from the group consisting of E, Q, G, D, A, K, R, L, P, S, V, H, T, N, W, M, and I (such as A, G, E, D, Q, R, S, or L, or such as G, E, or Q); a-3) the amino acid residue at position 45 is selected from the group consisting of L, R, P, H, F, G, Q, S, E, T, Y, C, I, D, and V (such as L, C, or R, or such as L or R); a-4) the amino acid residue at position 103 is selected from the group consisting of W, R, G, S, K, A, M, Y, I, F, T, N, V, Q, P, E, and C (such as W, G, or R, or such as W); and a-5) the amino acid residue at position 108 is selected from the group consisting of Q, L, R, P, E, K, S, T, M, A, and H (such as Q); or b-1) the amino acid residue at position 37 is selected from the group consisting of F, Y, L, I, and V (such as F or Y, or such as F); b-2) the amino acid residue at position 44 is selected from the group consisting of E and Q; b-3) the amino acid residue at position 45 is selected from the group consisting of L and R (such as R); b-4) the amino acid residue at position 103 is selected from the group consisting of G, W, R and S (such as W); and b-5) the amino acid residue at position 108 is selected from the group consisting of Q and L (such as Q); or c-1) the amino acid residue at position 37 is selected from the group consisting of F, Y, L, I, and V (such as F or Y, or such as F); c-2) the amino acid residue at position 44 is selected from the group consisting of A, G, E, D, Q, R, S and L (such as G, E, or Q); c-3) the amino acid residue at position 45 is selected from the group consisting of L, R and C (such as L or R); c-4) the amino acid residue at position 103 is selected from the group consisting of P, R and S (such as R or S); and c-5) the amino acid residue at position 108 is selected from the group consisting of Q and L (such as Q); wherein the amino acid position is according to Kabat numbering. In some embodiments, position 108 can be optionally humanized to L when position 108 is Q.

In some embodiments according to any one of the isolated anti-CTLA-4 constructs described above, the sdAb moiety specifically recognizing CTLA-4 comprises a $V_HH$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353. In some embodiments, the sdAb moiety specifically recognizing CTLA-4 comprises a $V_HH$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_HH$ domain. In some embodiments, the sdAb moiety specifically recognizing CTLA-4 comprises a $V_HH$ domain comprising the amino acid sequence of any one of SEQ ID NOs: 113-129, 200-202, 274-282, 341-344, 352, and 353. In some embodiments, the sdAb moiety specifically recognizing CTLA-4 comprises a $V_HH$ domain comprising the amino acid sequence of any one of SEQ ID NOs: 114, 129, 201, 202, 274-282, 341-344, 352, and 353.

In some embodiments according to any one of the isolated anti-CTLA-4 constructs described above, the $K_d$ of the binding between the sdAb moiety specifically recognizing CTLA-4 and CTLA-4 is about $10^{-5}$ M to about $10^{-12}$ M (such as about $10^{-5}$ M to about $10^{-12}$ M, about $10^{-7}$ M to about $10^{-12}$ M, or about $10^{-8}$ M to about $10^{-12}$ M).

In some embodiments according to any one of the isolated anti-CTLA-4 constructs described above, the sdAb moiety specifically recognizing CTLA-4 is camelid, chimeric, human, partially humanized, or fully humanized.

In some embodiments according to any one of the isolated anti-CTLA-4 constructs described above, the isolated anti-CTLA-4 construct is a heavy chain-only antibody (HCAb). In some embodiments, the sdAb moiety specifically recognizing CTLA-4 is fused to a human IgG1 Fc. In some embodiments, the HCAb is monomeric or dimeric. In some embodiments, the HCAb comprises the amino acid sequence of any one of SEQ ID NOs: 130-133, 283-291, and 366-371.

In some embodiments according to any one of the isolated anti-CTLA-4 construct described above, the isolated anti-CTLA-4 construct further comprises a second antibody moiety specifically recognizing a second antigen (or epitope). In some embodiments, the second antibody moiety is a full-length antibody, a Fab, a Fab', a (Fab')2, an Fv, a single chain Fv (scFv), an scFv-scFv, a minibody, a diabody, or an sdAb. In some embodiments, the anti-CTLA-4 construct is monospecific. In some embodiments, the anti-CTLA-4 construct is multispecific (such as bispecific). In some embodiments, the sdAb moiety specifically recognizing CTLA-4 is fused to the N-terminus and/or C-terminus of the second antibody moiety. In some embodiments, the sdAb moiety specifically recognizing CTLA-4 and the second antibody moiety are optionally connected by a peptide linker (such as SEQ ID NO: 162, 163, 307, or 365). In some embodiments, the second antibody moiety is an sdAb. In some embodiments, the second epitope is from CTLA-4. In some embodiments, the second epitope is not from CTLA-4. In some embodiments, the isolated anti-CTLA-4 construct comprises two or more sdAbs that specifically recognize CTLA-4 (such as same or different epitopes of CTLA-4). In some embodiments, the second epitope is from human serum albumin (HSA).

In some embodiments according to any one of the isolated anti-CTLA-4 construct described above, the isolated anti-CTLA-4 construct further comprises a second antibody moiety specifically recognizing a second antigen, wherein the second antibody moiety is a full-length antibody consisting of two heavy chains and two light chains. In some embodiments, the anti-CTLA-4 construct is monospecific. In some embodiments, the anti-CTLA-4 construct is multispecific (such as bispecific). In some embodiments, the sdAb moiety specifically recognizing CTLA-4 is fused to the N-terminus and/or C-terminus of the second antibody moiety. In some embodiments, the sdAb moiety specifically recognizing CTLA-4 and the second antibody moiety are optionally connected by a peptide linker (such as SEQ ID NO: 162, 163, 307, or 365). In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the C-terminus of the sdAb moiety specifically recognizing CTLA-4 is fused to the N-terminus of both heavy and light chains of the full-length antibody. In some embodiments, the full-length antibody specifically recognizes PD-1. In some embodiments, the full-length antibody comprises a heavy chain comprising the amino acid sequence of SEQ ID NO: 158, and a light chain comprising the amino acid sequence of SEQ ID NO: 159. In some embodiments, the full-length antibody comprises a heavy chain comprising the amino acid sequence of SEQ ID NO: 160, and a light chain comprising the amino acid sequence of SEQ ID NO: 161. In some embodiments, the full-length antibody comprises a heavy chain comprising the amino acid sequence of SEQ ID NO: 308, and a light chain comprising the amino acid sequence of SEQ ID NO: 309. In some embodiments, the full-length antibody comprises a heavy chain comprising the amino acid sequence of SEQ ID NO: 158, and a light chain comprising the amino acid sequence of SEQ ID NO: 159, wherein at least one of the heavy chains of the full-length antibody is fused to the anti-CTLA-4 sdAb, and wherein the heavy chain fusion polypeptide comprises the amino acid sequence of any one of SEQ ID NOs: 134-145, 292-296, and 319-323. In some embodiments, the full-length antibody comprises a heavy chain comprising the amino acid sequence of SEQ ID NO: 160, and a light chain comprising the amino acid sequence of SEQ ID NO: 161, wherein at least one of the heavy chains of the full-length antibody is fused to the anti-CTLA-4 sdAb, and wherein the heavy chain fusion polypeptide comprises the amino acid sequence of any one of SEQ ID NOs: 146-157, 297-301, and 324-328. In some embodiments, the full-length antibody comprises a heavy chain comprising the amino acid sequence of SEQ ID NO: 308, and a light chain comprising the amino acid sequence of SEQ ID NO: 309, wherein at least one of the heavy chains of the full-length antibody is fused to the anti-CTLA-4 sdAb, and wherein the heavy chain fusion polypeptide comprises the amino acid sequence of any one of SEQ ID NOs: 310-318 and 329-337. In some embodiments, the full-length antibody comprises a heavy chain comprising the amino acid sequence of SEQ ID NO: 158, and a light chain comprising the amino acid sequence of SEQ ID NO: 159, wherein at least one of the light chains of the full-length antibody is fused to the anti-CTLA-4 sdAb, and wherein the light chain fusion polypeptide comprises the amino acid sequence of any one of SEQ ID NOs: 354 and 355. In some embodiments, the full-length antibody comprises a heavy chain comprising the amino acid sequence of SEQ ID NO: 158, and a light chain comprising the amino acid sequence of SEQ ID NO: 159, wherein the anti-CTLA-4 sdAb is fused to the N-terminus of both heavy and light chains of the full-length antibody, and wherein the heavy chain fusion polypeptide comprises the amino acid sequence of SEQ ID NO: 356, and the light chain fusion polypeptide comprises the amino acid sequence of SEQ ID NO: 357. In some embodiments, the anti-CTLA-4 construct comprises four identical sdAbs specifically recognizing CTLA-4, wherein fused to the N-terminus of each heavy chain of the full-length antibody are two identical sdAbs, wherein the two identical sdAbs are fused to each other via an optional peptide linker, and wherein the two identical sdAbs are fused to the N-terminus of each heavy chain of the full-length antibody via an optional peptide linker. In some embodiments, the full-length antibody comprises a heavy chain comprising the amino acid sequence of SEQ ID NO: 158, and a light chain comprising the amino acid sequence of SEQ ID NO: 159, and wherein the heavy chain fusion polypeptide comprises the amino acid sequence of SEQ ID NO: 358. In some embodiments, the full-length antibody specifically recognizes PD-L1. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the full-length antibody comprises a heavy chain comprising the amino acid sequence of SEQ ID NO: 195, and a light chain comprising the amino acid sequence of SEQ ID NO: 196, wherein at least one of the heavy chains of the full-length antibody is fused to the anti-CTLA-4 sdAb, and wherein the heavy chain fusion polypeptide comprises the amino acid sequence of any one of SEQ ID NOs: 171-182, 302-306, and 345-349. In some embodiments, the full-length antibody comprises a heavy chain comprising the amino acid sequence of SEQ ID NO: 197, and a light chain comprising the amino acid sequence of SEQ ID NO: 198, wherein at least one of the heavy chains of the full-length antibody is fused to the anti-CTLA-4 sdAb, and wherein the heavy chain fusion polypeptide comprises the amino acid sequence of any one of SEQ ID NOs: 183-194. the anti-CTLA-4 construct comprises four identical sdAbs specifically recognizing CTLA-4, wherein fused to the N-terminus of each heavy chain of the full-length antibody are two identical sdAbs, wherein the two identical sdAbs are fused to each other via an optional peptide linker, and wherein the two identical sdAbs are fused to the N-terminus of each heavy chain of the full-length antibody via an optional peptide linker.

In some embodiments according to any one of the isolated anti-CTLA-4 constructs described above, the anti-CTLA-4 construct comprises: (a) a first antigen binding portion comprising any of the sdAb moiety specifically recognizing CTLA-4 described above, and (b) a second antigen binding portion comprising a heavy chain variable domain ($V_H$) and a light chain variable domain ($V_L$), wherein the $V_H$ and $V_L$, together form an antigen-binding site that specifically binds a second epitope, wherein the first antigen binding portion and the second antigen binding portion are fused to each other. In some embodiments, the second epitope is from CTLA-4. In some embodiments, the second epitope is not from CTLA-4. In some embodiments, the anti-CTLA-4 construct is bispecific. In some embodiments, the second antigen binding portion is a full-length antibody consisting of two heavy chains and two light chains. In some embodiments, the second antigen binding portion is an antibody fragment comprising a heavy chain comprising the $V_H$ and a light chain comprising the $V_L$ (such as a Fab). In some embodiments, the first antigen binding portion comprises a single polypeptide chain comprising the sdAb moiety specifically recognizing CTLA-4. In some embodiments, the first antigen binding portion comprises two identical sdAb moieties specifically recognizing CTLA-4 fused together via an optional peptide linker. In some embodiments, the C-terminus of the first antigen binding portion is fused to the N-terminus of at least one heavy chain of the second antigen binding portion. In some embodiments, the C-terminus of the first antigen binding portion is fused to the N-terminus of at least one light chain of the second antigen binding portion. In some embodiments, the N-terminus of the first antigen binding portion is fused to the C-terminus of at least one heavy chain of the second antigen binding portion. In some embodiments, the N-terminus of the first antigen binding portion is fused to the C-terminus of at least one light chain of the second antigen binding portion. In some embodiments, the C-terminus of the first antigen binding portion is fused to the N-terminus of both heavy and light chains of the second antigen binding portion. In some embodiments, the second antigen binding portion is an scFv. In some embodiments, the C-terminus of the first antigen binding portion is fused to the N-terminus of the second antigen binding portion. In some embodiments, the N-terminus of the first antigen binding portion is fused to the C-terminus of the second antigen binding portion. In some embodiments, the first antigen binding portion is a Fab-like domain comprising a first polypeptide chain comprising a first sdAb moiety specifically recognizing CTLA-4 fused to a $C_H1$ domain, and a second polypeptide chain comprising a second sdAb moiety specifically recognizing CTLA-4 fused to a $C_L$ domain. In some embodiments, the first antigen binding portion is fused to the N-terminus of the second antigen binding portion. In some embodiments, the first antigen binding portion is fused to the C-terminus of the second antigen binding portion. In some embodiments, the first and/or second antigen binding portion comprises a human, humanized, human, or chimeric antibody or antigen binding fragment thereof. In some embodiments, the second antigen binding portion comprises an Fc region. In some embodiments, the first antigen binding portion is fused to the N-terminus of the Fc region. In some embodiments, the Fc region is an IgG1 Fc. In some embodiments, the Fc region is an IgG4 Fc having an S228P mutation. In some embodiments, the first antigen binding portion and the second antigen binding portion are fused to each other via an optional peptide linker (such as peptide linker comprising the amino acid sequence of SEQ ID NO: 162, 163, 307, or 365). In some embodiments, the second epitope is from an immune checkpoint molecule, such as PD-1, PD-L1. In some embodiments, the second antigen binding portion is an anti-PD-1 antibody or antigen binding fragment thereof. In some embodiments, the anti-PD-1 antibody comprises a heavy chain comprising the amino acid sequence of SEQ ID NO: 158, and a light chain comprising the amino acid sequence of SEQ ID NO: 159. In some embodiments, the anti-PD-1 antibody comprises a heavy chain comprising the amino acid sequence of SEQ ID NO: 160, and a light chain comprising the amino acid sequence of SEQ ID NO: 161. In some embodiments, the full-length antibody comprises a heavy chain comprising the amino acid sequence of SEQ ID NO: 308, and a light chain comprising the amino acid sequence of SEQ ID NO: 309. In some embodiments, the anti-CTLA-4 construct comprises two copies of heavy chain fusion polypeptide comprising the amino acid sequence of any one of SEQ ID NOs: 134-145, 292-296, 319-323, 358, and 359, and two copies of light chains comprising the amino acid sequence of SEQ ID NO: 159. In some embodiments, the anti-CTLA-4 construct comprises two copies of heavy chains comprising the amino acid sequence of SEQ ID NO: 158, and two copies of light chain fusion polypeptide comprising the amino acid sequence of SEQ ID NO: 354 or 355. In some embodiments, the anti-CTLA-4 construct comprises two copies of heavy chain fusion polypeptide comprising the amino acid sequence of SEQ ID NO: 356, and two copies of light chain fusion polypeptide comprising the amino acid sequence of SEQ ID NO: 357. In some embodiments, the anti-CTLA-4 construct comprises two copies of heavy chain fusion polypeptide comprising the amino acid sequence of SEQ ID NO: 361, and two copies of light chain fusion polypeptide comprising the amino acid sequence of SEQ ID NO: 362. In some embodiments, the anti-CTLA-4 construct comprises two copies of heavy chain fusion polypeptide comprising the amino acid sequence of SEQ ID NO: 363, and two copies of light chain fusion polypeptide comprising the amino acid sequence of SEQ ID NO: 364. In some embodiments, the anti-CTLA-4 construct comprises two copies of polypeptide comprising the amino acid sequence of SEQ ID NO: 360. In some embodiments, the anti-CTLA-4 construct comprises two copies of heavy chain fusion polypeptide comprising the amino acid sequence of any one of SEQ ID NOs: 146-157, 297-301, and 324-328, and two copies of light chains comprising the amino acid sequence of SEQ ID NO: 161. In some embodiments, the anti-CTLA-4 construct comprises two copies of heavy chain fusion polypeptide comprising the amino acid sequence of any one of SEQ ID NOs: 310-318 and 329-337, and two copies of light chains comprising the amino acid sequence of SEQ ID NO: 309. In some embodiments, the second antigen binding portion is an anti-PD-L1 antibody or antigen binding fragment thereof. In some embodiments, the anti-PD-L1 antibody comprises a heavy chain comprising the amino acid sequence of SEQ ID NO: 195, and a light chain comprising the amino acid sequence of SEQ ID NO: 196. In some embodiments, the anti-PD-L1 antibody comprises a heavy chain comprising the amino acid sequence of SEQ ID NO: 197, and a light chain comprising the amino acid sequence of SEQ ID NO: 198. In some embodiments, the anti-CTLA-4 construct comprises two copies of heavy chain fusion polypeptide comprising the amino acid sequence of any one of SEQ ID NOs: 171-182, 302-306, and 345-349, and two copies of light chains comprising the amino acid sequence of SEQ ID NO: 196. In some embodiments, the anti-CTLA-4 construct comprises two copies of heavy chain fusion polypeptide comprising the amino acid sequence of any one of SEQ ID NOs: 183-194, and two copies of light chains comprising the amino acid sequence of SEQ ID NO: 198.

In some embodiments according to any one of the isolated anti-CTLA-4 constructs described above, the isolated anti-CTLA-4 construct further comprises a biologically active protein or fragments thereof.

Further provided is an isolated anti-CTLA-4 construct comprising a sdAb moiety specifically recognizing CTLA-4, wherein the sdAb moiety comprises CDR1, CDR2, and CDR3 of any one of SEQ ID NOs: 113-129, 200-202, 274-282, 341-344, 352, and 353.

Further provided is an isolated anti-CTLA-4 construct that specifically binds to CTLA-4 competitively with any one of the isolated anti-CTLA-4 constructs described above.

Further provided is a pharmaceutical composition comprising any one of the isolated anti-CTLA-4 constructs described above, and a pharmaceutical acceptable carrier.

Another aspect of the present application provides a method of treating an individual having a CTLA-4-related disease, comprising administering to the individual an effective amount of any one of the pharmaceutical composition described above. In some embodiments, the CTLA-4 related disease is cancer. In some embodiments, the cancer is a solid tumor, such as a colon cancer. In some embodiments, the method further comprises administering to the individual an additional cancer therapy, such as surgery, radiation, chemotherapy, immunotherapy, hormone therapy, or a combination thereof. In some embodiments, the CTLA-4 related disease is a pathogenic infection. In some embodiments, the pharmaceutical composition is administered systemically, such as intravenously (i.v.) or intraperitoneally (i.p.). In some embodiments, the pharmaceutical composition is administered locally, such as intratumorally. In some embodiments, the individual is a human.

Further provided is an isolated nucleic acid encoding any one of the isolated anti-CTLA-4 construct described above. In some embodiments, the isolated nucleic acid comprises the nucleic acid sequence of any one of SEQ ID NOs: 97-112 and 264-273.

Further provided is a vector comprising any one of the isolated nucleic acid described above.

Further provided is an isolated host cell comprising any one of the isolated nucleic acid or vector described above.

Further provided is a kit comprising any one of the isolated anti-CTLA-4 construct, isolated nucleic acid, vector, or isolated host cell described above.

Another aspect of the present application provides a method of producing any one of isolated anti-CTLA-4 construct described above, comprising culturing a host cell comprising any one of the isolated nucleic acid or vector described above, or culturing any one of the isolated host cell described above, under conditions effective to express the encoded anti-CTLA-4 construct; and obtaining the expressed anti-CTLA-4 construct from said host cell. In some embodiments, the method further comprises producing a host cell comprising any one of the isolated nucleic acid or vector described above.

BRIEF DESCRIPTION OF THE DRAWINGS

FIG. 6 depicts sdAb sequences alignment of A34311 (WT) and top 3 clones after humanization. Amino acid differences in the framework regions relative to the human acceptor (best human germline sequence sharing the highest degree of homology with sdAb A34311) are shaded in dark grey.

FIG. 8 depicts functional activity evaluation of A34311 sdAb and AS02640 sdAb by CTLA-4-based blockade assay.

FIG. 11A depicts the experimental timeline. FIG. 11B demonstrates the ability of A34311 HCAb and AS02640 HCAb in inhibiting tumor growth in vivo, with a comparable efficacy as the in-house generated Yervoy (ipilimumab) biosimilar antibody (4-chain antibody, having substantially the same amino acid sequence as Yervoy®). FIG. 11C indicates that the body weights of MC38 engrafted mice were unaffected by treatment.

FIGS. 13A-13E depict affinity determination of two exemplary bispecific CTLA-4×PD-1 antibodies for CTLA-4 binding. A34311 HCAb and Yervoy® served as anti-CTLA-4 positive controls. The antibodies were immobilized onto the chip and CTLA-4-His protein was flowed as analyte at concentrations of 0.78, 1.56, 3.15, 6.25, 12.5, 25, 50, and 100 nM.

FIGS. 18A-18J depict FACS-based ligand competition evaluation of anti-CTLA-4 HCAbs. Yervoy® served as a positive anti-CTLA-4 antibody control. $IC_{50}$ from all assays was summarized in FIG. 18J.

FIGS. 19A-19L depict FACS-based ligand competition evaluation of exemplary bispecific CTLA-4×PD-1 or CTLA-4×PD-L1 antibodies for binding to CTLA-4. Yervoy® served as a positive anti-CTLA-4 antibody control. Human IgG served as a negative control. $IC_{50}$ from all assays was summarized in FIG. 19L.

FIGS. 20A-20J depict FACS-based ligand competition evaluation of exemplary bispecific CTLA-4×PD-1 antibodies for binding to PD-1. Keytruda® and Opdivo® served as positive anti-PD-1 antibody controls. $IC_{50}$ from all assays was summarized in FIG. 20J.

FIGS. 21A-21G depict FACS-based ligand competition evaluation of exemplary bispecific CTLA-4×PD-L1 antibodies for binding to PD-L1. Tecentriq® served as a positive anti-PD-L1 antibody control. Keytruda® served as an anti-PD-1 antibody control. Human IgG were used as negative controls. $IC_{50}$ from all assays was summarized in FIG. 21G.

FIGS. 22A-22B depict the affinity determination of AS07014 sdAb and AS07089 sdAb. CTLA-4-His protein was immobilized onto the chip and the two sdAbs were flowed as analyte at concentrations of 5, 10, 20, 40, 80 and 160 nM. Kinetics data were summarized in FIG. 22B.

FIGS. 23A-23B depict the affinity determination of exemplary anti-CTLA-4 HCAbs and their humanized HCAbs. CTLA-4-His protein was immobilized onto the chip and the HCAbs were flowed as analyte at concentrations of 5, 10, 20, 40, 80 and 160 nM. Kinetics data were summarized in FIG. 23B.

FIGS. 24A-24B depict the affinity determination of exemplary bispecific CTLA-4×PD-1 or CTLA-4×PD-L1 antibodies for binding to CTLA-4. Yervoy® was used as a positive control for anti-CTLA-4 antibody. Antibodies were immobilized onto the chip and the CTLA-4-His protein was flowed as analyte at concentrations of 12.5, 25, 50, 100 and 200 nM. Kinetics data were summarized in FIG. 24B.

FIGS. 27A-27C depict functional activity evaluation of purified sdAbs by CTLA-4-based blockade assay (FIG. 27A). Yervoy® served as a positive anti-CTLA-4 antibody control (FIG. 27B). $EC_{50}$ from all assays was summarized in FIG. 27C.

FIGS. 28A-28B depict functional activity evaluation of purified HCAbs (including humanized HCAbs) by CTLA-4-based blockade assay. Yervoy® served as a positive anti-CTLA-4 antibody control, while human IgG served as a negative control (FIG. 28A). $EC_{50}$ from all assays was summarized in FIG. 28B.

FIGS. 31A-31C depict selected camelid sdAb sequences (A34311, AS07014 and AS07189) and their corresponding humanized sdAbs as well as the human acceptor.

FIGS. 32A-32B depict FACS-based cell binding evaluation of humanized anti-CTLA-4 HCAbs to CTLA-4 expressing CHO cells. Yervoy® served as a positive anti-CTLA-4 antibody control. $EC_{50}$ from all assays was summarized in FIG. 32B.

FIG. 36A depicts the experimental timeline. FIG. 36B demonstrates the ability of A34311 HCAb, AS07014VH11 HCAb and AS07189TKDVH11 HCAb in inhibiting tumor growth in vivo, with a comparable efficacy as the Yervoy biosimilar. FIG. 36C indicates that body weights of MC38 engrafted mice were unaffected by treatments.

FIG. 37A demonstrates the ability of BCP-75, BCP-79, and BCP-80 bispecific antibodies in inhibiting tumor growth in vivo, with a comparable efficacy as the in-house expressed Keytruda (pembrolizumab) biosimilar and Opdivo (nivolumab) biosimilar (4-chain antibody). FIG. 37B indicates that the body weights of MC38 engrafted mice were unaffected by treatments.

FIG. 38A demonstrates the ability of BCP-75 and BCP-79 bispecific antibodies in inhibiting tumor growth in vivo. AS07014VH11 HCAb and AS07189TKDVH11 HCAb with same Fc region as Keytruda® served as controls for the two bispecific antibodies. Yervoy biosimilar served as positive control for this assay. FIG. 38B indicates that the body weights of MC38 engrafted mice were unaffected by treatments.

FIG. 37A demonstrates the ability of BCP-84 and BCP-85 bispecific antibodies in inhibiting tumor growth in vivo, with a comparable efficacy as the combination therapy groups Tecentriq biosimilar plus AS07014VH11 HCAb and Tecentriq biosimilar plus AS07189TKDVH11 HCAb. FIG. 39B indicates that the body weights of MC38 engrafted mice were unaffected by treatments.

For example, the BABP can consist of two polypeptide chains each with a structure from the N-terminus to the C-terminus as follows: $V_L$-$V_H$-$V_H$H-$C_H$2-$C_H$3, wherein $V_H$ and $V_L$ of each polypeptide chain forms a scFv domain that specifically binds a copy of the first epitope, and each $V_H$H specifically binds a copy of the second epitope. In alternative formats, the scFv domain can comprise from the N-terminus to the C-terminus: $V_H$-$V_L$. Additionally, to expand specificity, the two scFvs can specifically bind different epitopes, and/or the $V_H$H fragments can specifically bind different epitopes.

Figure 48:
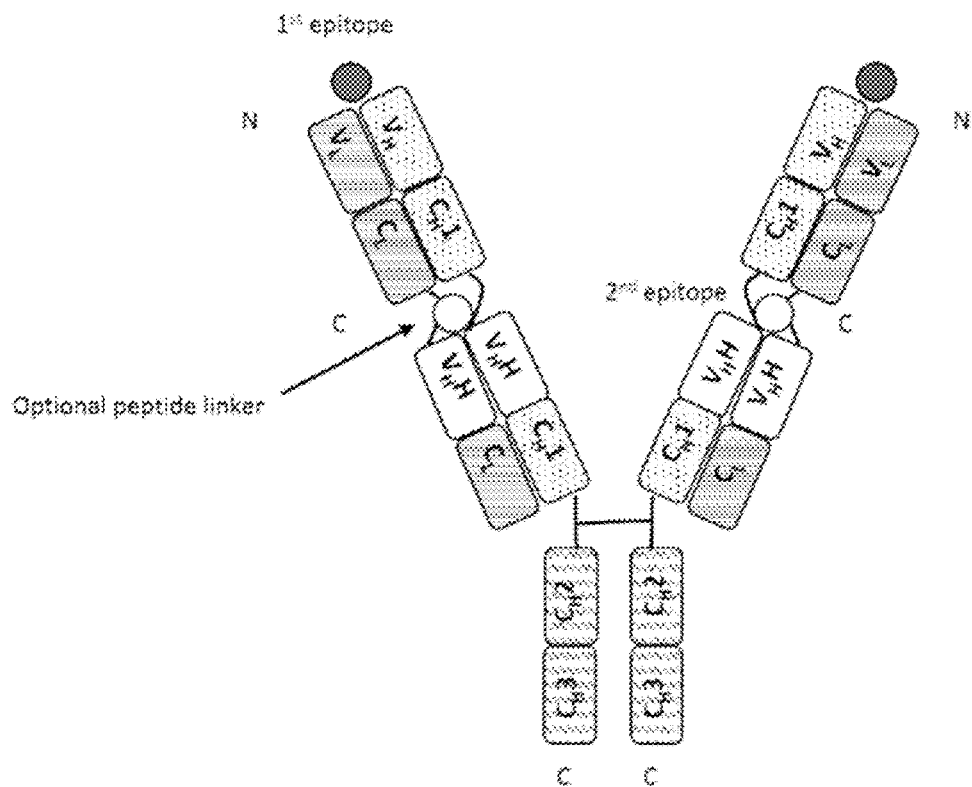

FIG. 48 depicts a schematic structure of an exemplary BABP comprising two identical antigen-binding (Fab) fragments, two identical Fab-like fragments each comprising two $V_H$H fragments, and an Fc region. In each Fab-like domain, the $V_H$ and $V_L$ regions are each replaced by an sdAb. Each Fab fragment specifically binds a first epitope, and each Fab-like fragment specifically binds a second epitope. For example, the BABP can consist of four polypeptide chains with structures from the N-terminus to the C-terminus as follows: (1) $V_L$-$C_L$-$V_H$H-$C_L$; (2) $V_H$-$C_H$1-$V_H$H-$C_H$1-$C_H$2-$C_H$3; (3) $V_H$-$C_H$1-$V_H$H-$C_H$1-$C_H$2-$C_H$3; and (4) $V_L$-$C_L$-$V_H$H-$C_L$, wherein $V_H$ and $V_L$ of polypeptide chains (1) and (2) forms an antigen binding site that specifically binds a first copy of the first epitope, $V_H$ and $V_L$ of polypeptide chains (3) and (4) forms an antigen binding site that specifically binds a second copy of the first epitope, and each $V_H$H specifically binds a copy of the second epitope. In alternative formats, to expand specificity, the two Fab fragments can specifically bind different epitopes, and/or the Fab-like fragments can specifically bind different epitopes.

Figure 49:
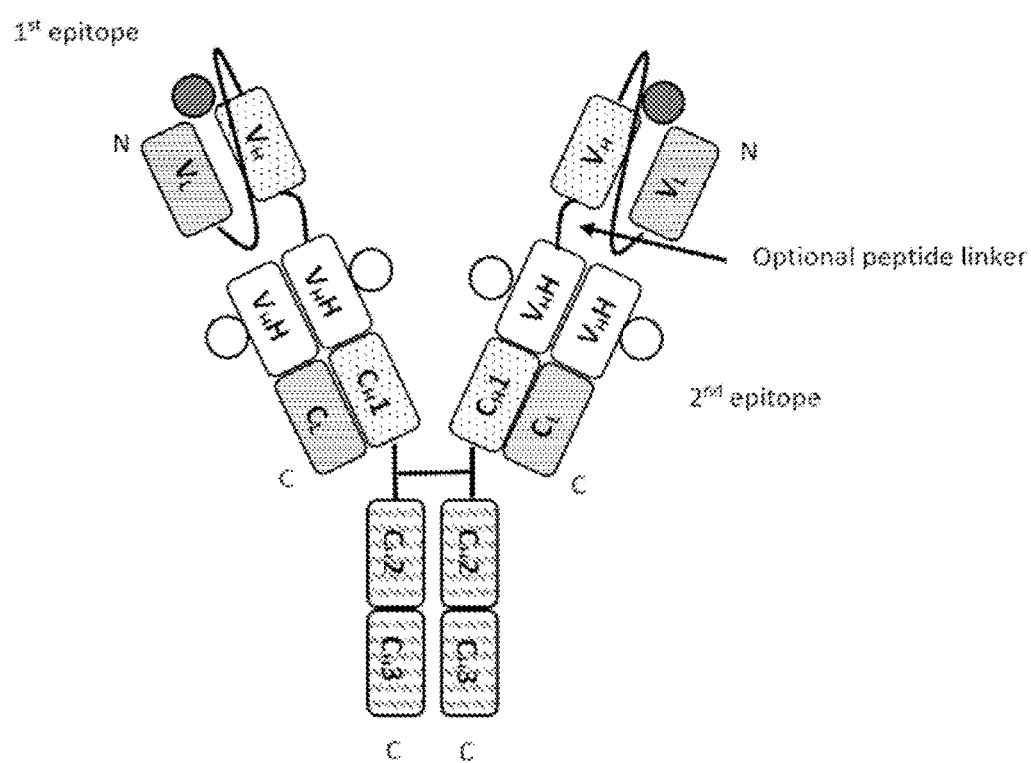

FIG. 49 depicts a schematic structure of an exemplary BABP comprising two identical scFvs, two identical Fab-like fragments each comprising two $V_H$H fragments, and an Fc region. In each Fab-like domain, the $V_H$ and $V_L$ regions are each replaced by an sdAb. For example, the BABP can consist of four polypeptide chains with structures from the N-terminus to the C-terminus as follows: (1) $V_H$H-$C_L$; (2) $V_L$-$V_H$-$V_H$H-$C_H$1-$C_H$2-$C_H$3; (3) $V_L$-$V_H$-$V_H$H-$C_H$1-$C_H$2-$C_H$3; and (4) $V_H$H-$C_L$, wherein $V_H$ and $V_L$ of polypeptide chains (2) and (3) each forms an scFv that specifically binds a copy of the first epitope, and each $V_H$H specifically binds a copy of the second epitope. In alternative formats, the C-terminus of the scFv may be fused to the N-terminus of the chain in the Fab-like fragment comprising $V_H$H-$C_L$; and/or the scFv domain can comprise from the N-terminus to the C-terminus: $V_H$-$V_L$. Additionally, to expand specificity, the two scFvs can specifically bind different epitopes, and/or the $V_H$H fragments can specifically bind different epitopes.

DETAILED DESCRIPTION OF THE INVENTION

The present invention provides novel single-domain antibody (sdAb) specifically recognizing CTLA-4 (hereinafter also referred to as "anti-CTLA-4 sdAb") and its antibody variants (for example, a larger protein or polypeptide comprising the anti-CTLA-4 sdAb, such as a heavy chain-only antibody (HCAb), anti-CTLA-4 sdAb fused to a full-length antibody, Fab, scFv, or multispecific antigen binding proteins (MABPs) comprising the anti-CTLA-4 sdAb), uses thereof for treating CTLA-4-related diseases, such as cancer.

Single-chain antibodies (sdAbs) are different from conventional 4-chain antibodies by having a single monomeric antibody variable domain, such as heavy chain variable domain ($V_H$H), which can exhibit high affinity to an antigen without the aid of a light chain. Camelid $V_H$H is known as the smallest functional antigen-binding fragment with a molecular weight of approximately 15 kD.

Accordingly, one aspect of the present application provides an isolated anti-CTLA-4 construct comprising an sdAb moiety specifically recognizing CTLA-4. The isolated anti-CTLA-4 construct can be, for example, an anti-CTLA-4 sdAb (e.g. natural or humanized), a polypeptide comprising multiple anti-CTLA-4 sdAbs described herein fused together, an HCAb comprising an anti-CTLA-4 sdAb described herein fused to an Fc fragment (e.g., a human IgG1 Fc), or a MABP comprising the anti-CTLA-4 sdAb described herein fused to fused to a full-length antibody (such as an anti-PD-1 antibody, or an anti-PD-L1 antibody) or antigen binding fragment that comprise a heavy chain variable domain ($V_H$) and a light chain variable domain ($V_L$). The anti-CTLA-4 construct can be monospecific or multispecific (such as bispecific), monovalent or multivalent (such as bivalent).

Also provided are compositions (such as pharmaceutical compositions), kits and articles of manufacture comprising the construct comprising an anti-CTLA-4 sdAb moiety, methods of making the construct comprising an anti-CTLA-4 sdAb moiety, and methods of treating CTLA-4 related disease (such as cancer) using the construct comprising an anti-CTLA-4 sdAb moiety.

I. Definitions

The terms "cytotoxic T lymphocyte-associated antigen-4," "CTLA-4," "CTLA4," "CTLA-4 antigen" and "CD152" (see, e.g., Murata (1999) *Am. J. Pathol.* 155:453-460) are used interchangeably, and include variants, isoforms, species homologs of human CTLA-4, and analogs having at least one common epitope with CTLA-4 (see, e.g., Balzano (1992) *Int. J. Cancer Suppl.* 7:28-32). Accordingly, the anti-CTLA-4 construct of the invention may, in certain cases, cross-react with CTLA-4 from species other than human, or other proteins which are structurally related to human CTLA-4 (e.g., human CTLA-4 homologs). In other cases, the anti-CTLA-4 construct may be completely specific for human CTLA-4 and not exhibit species or other types of cross-reactivity.

The term "human CTLA-4" refers to human sequence CTLA-4, such as the complete amino acid sequence of human CTLA-4 having Genbank Accession Number NP_005205. The human CTLA-4 sequence may differ from human CTLA-4 of Genbank Accession Number NP_005205 by having, for example, conserved mutations or mutations in non-conserved regions and the CTLA-4 has substantially the same biological function as the human CTLA-4 of Genbank Accession Number NP_005205. For example, a biological function of human CTLA-4 is having an epitope in the extracellular domain of CTLA-4 that is specifically bound by an anti-CTLA-4 construct of the instant disclosure or a biological function of human CTLA-4 is modulation of T cell activity.

The term "epitope" means a protein determinant capable of specific binding to an antibody. Epitopes usually consist of chemically active surface groupings of molecules such as amino acids or sugar side chains and usually have specific three dimensional structural characteristics, as well as specific charge characteristics. Conformational and non-conformational epitopes are distinguished in that the binding to the former but not the latter is lost in the presence of denaturing solvents.

The term "B7 ligand" as used herein is intended to refer to members of the B7 family of molecules that are ligands for CTLA-4 (i.e., members of the B7 family of molecules that are capable of binding CTLA-4). Examples of B7 ligands are B7-1 and B7-2. The amino acid and DNA sequences of human B7-1 (CD80) are disclosed at Genbank Accession Numbers NP_005182 and NM_005191, respectively. The amino acid and DNA sequences of human B7-2 (CD86) (isoform 1) is disclosed at Genbank Accession Numbers NP_787058 and NM_175862, respectively; the amino acid and DNA sequences of human B7-2 (CD86) (isoform 2) is disclosed at Genbank Accession Numbers NP_008820 and NM_006889, respectively.

As used herein, "treatment" or "treating" is an approach for obtaining beneficial or desired results including clinical results. For purposes of this invention, beneficial or desired clinical results include, but are not limited to, one or more of the following: alleviating one or more symptoms resulting from the disease, diminishing the extent of the disease, stabilizing the disease (e.g., preventing or delaying the worsening of the disease), preventing or delaying the spread (e.g., metastasis) of the disease, preventing or delaying the recurrence of the disease, delay or slowing the progression of the disease, ameliorating the disease state, providing a remission (partial or total) of the disease, decreasing the dose of one or more other medications required to treat the disease, delaying the progression of the disease, increasing the quality of life, and/or prolonging survival. Also encompassed by "treatment" is a reduction of pathological consequence of cancer. The methods of the invention contemplate any one or more of these aspects of treatment.

The term "prevent," and similar words such as "prevented," "preventing" etc., indicate an approach for preventing, inhibiting, or reducing the likelihood of the recurrence of, a disease or condition, e.g., cancer. It also refers to delaying the recurrence of a disease or condition or delaying the recurrence of the symptoms of a disease or condition. As used herein, "prevention" and similar words also includes reducing the intensity, effect, symptoms and/or burden of a disease or condition prior to recurrence of the disease or condition.

As used herein, "delaying" the development of cancer means to defer, hinder, slow, retard, stabilize, and/or postpone development of the disease. This delay can be of varying lengths of time, depending on the history of the disease and/or individual being treated. A method that "delays" development of cancer is a method that reduces probability of disease development in a given time frame and/or reduces the extent of the disease in a given time frame, when compared to not using the method. Such comparisons are typically based on clinical studies, using a statistically significant number of individuals. Cancer development can be detectable using standard methods, including, but not limited to, computerized axial tomography (CAT Scan), Magnetic Resonance Imaging (MRI), abdominal ultrasound, clotting tests, arteriography, or biopsy. Development may also refer to cancer progression that may be initially undetectable and includes occurrence, recurrence, and onset.

The term "effective amount" used herein refers to an amount of an agent or a combination of agents, sufficient to treat a specified disorder, condition or disease such as ameliorate, palliate, lessen, and/or delay one or more of its symptoms. In reference to cancer, an effective amount comprises an amount sufficient to cause a tumor to shrink and/or to decrease the growth rate of the tumor (such as to suppress tumor growth) or to prevent or delay other unwanted cell proliferation. In some embodiments, an effective amount is an amount sufficient to delay development. In some embodiments, an effective amount is an amount sufficient to prevent or delay recurrence. An effective amount can be administered in one or more administrations. The effective amount of the drug or composition may: (i) reduce the number of cancer cells; (ii) reduce tumor size; (iii) inhibit, retard, slow to some extent and preferably stop cancer cell infiltration into peripheral organs; (iv) inhibit (i.e., slow to some extent and preferably stop) tumor metastasis; (v) inhibit tumor growth; (vi) prevent or delay occurrence and/or recurrence of tumor; and/or (vii) relieve to some extent one or more of the symptoms associated with the cancer.

As used herein, an "individual" or a "subject" refers to a mammal, including, but not limited to, human, bovine, horse, feline, canine, rodent, or primate. In some embodiments, the individual is a human.

The terms "antibody," "antigen binding portion," or "antibody moiety" are used in their broadest sense and encompasses various antibody structures, including but not limited to monoclonal antibodies, polyclonal antibodies, multispecific antibodies (e.g., bispecific antibodies), full-length antibodies and antigen-binding fragments thereof, so long as they exhibit the desired antigen-binding activity.

The basic 4-chain antibody unit is a heterotetrameric glycoprotein composed of two identical light (L) chains and two identical heavy (H) chains. An IgM antibody consists of 5 of the basic heterotetramer units along with an additional polypeptide called a J chain, and contains 10 antigen-binding sites, while IgA antibodies comprise from 2-5 of the basic 4-chain units which can polymerize to form polyvalent assemblages in combination with the J chain. In the case of IgGs, the 4-chain unit is generally about 150,000 Daltons. Each L chain is linked to an H chain by one covalent disulfide bond, while the two H chains are linked to each other by one or more disulfide bonds depending on the H chain isotype. Each H and L chain also has regularly spaced intrachain disulfide bridges. Each H chain has at the N-terminus, a variable domain ($V_H$) followed by three constant domains ($C_H$) for each of the α and γ chains and four $C_H$ domains for μ and ε isotypes. Each L chain has at the N-terminus, a variable domain ($V_L$) followed by a constant domain at its other end. The $V_L$ is aligned with the $V_H$ and the $C_L$ is aligned with the first constant domain of the heavy chain ($C_H1$). Particular amino acid residues are believed to form an interface between the light chain and heavy chain variable domains. The pairing of a $V_H$ and $V_L$ together forms a single antigen-binding site. For the structure and properties of the different classes of antibodies, see e.g., *Basic and Clinical Immunology*, 8th Edition, Daniel P. Sties, Abba I. Terr and Tristram G. Parsolw (eds), Appleton & Lange, Norwalk, Conn., 1994, page 71 and Chapter 6. The L chain from any vertebrate species can be assigned to one of two clearly distinct types, called kappa and lambda, based on the amino acid sequences of their constant domains. Depending on the amino acid sequence of the constant domain of their heavy chains ($C_H$), immunoglobulins can be assigned to different classes or isotypes. There are five classes of immunoglobulins: IgA, IgD, IgE, IgG and IgM, having heavy chains designated α, δ, ε, γ and μ respectively. The γ and α classes are further divided into subclasses on the basis of relatively minor differences in the $C_H$ sequence and function, e.g., humans express the following subclasses: IgG1, IgG2A, IgG2B, IgG3, IgG4, IgA1 and IgA2.

The term "heavy chain-only antibody" or "HCAb" refers to a functional antibody, which comprises heavy chains, but lacks the light chains usually found in 4-chain antibodies. Camelid animals (such as camels, llamas, or alpacas) are known to produce HCAbs.

The term "single-domain antibody" or "sdAb" refers to a single antigen-binding polypeptide having three complementary determining regions (CDRs). The sdAb alone is capable of binding to the antigen without pairing with a corresponding CDR-containing polypeptide. In some cases, single-domain antibodies are engineered from camelid HCAbs, and their heavy chain variable domains are referred herein as "$V_H$Hs" (Variable domain of the heavy chain of the Heavy chain antibody). Camelid sdAb is one of the smallest known antigen-binding antibody fragments (see, e.g., Hamers-Casterman et al., Nature 363:446-8 (1993); Greenberg et al., Nature 374:168-73 (1995); Hassanzadeh-Ghassabeh et al., Nanomedicine (Lond), 8:1013-26 (2013)). A basic $V_H$H has the following structure from the N-terminus to the C-terminus: FR1-CDR1-FR2-CDR2-FR3-CDR3-FR4, in which FR1 to FR4 refer to framework regions 1 to 4, respectively, and in which CDR1 to CDR3 refer to the complementarity determining regions 1 to 3.

An "isolated" antibody (or construct) is one that has been identified, separated and/or recovered from a component of its production environment (e.g., natural or recombinant). Preferably, the isolated polypeptide is free of association with all other components from its production environment. Contaminant components of its production environment, such as that resulting from recombinant transfected cells, are materials that would typically interfere with research, diagnostic or therapeutic uses for the antibody, and may include enzymes, hormones, and other proteinaceous or non-proteinaceous solutes. In preferred embodiments, the polypeptide will be purified: (1) to greater than 95% by weight of antibody as determined by, for example, the Lowry method, and in some embodiments, to greater than 99% by weight; (2) to a degree sufficient to obtain at least 15 residues of N-terminal or internal amino acid sequence by use of a spinning cup sequenator; or (3) to homogeneity by SDS-PAGE under non-reducing or reducing conditions using Coomassie Blue or, preferably, silver stain. Isolated antibody (or construct) includes the antibody in situ within recombinant cells since at least one component of the antibody's natural environment will not be present. Ordinarily, however, an isolated polypeptide, antibody, or construct will be prepared by at least one purification step.

The "variable region" or "variable domain" of an antibody refers to the amino-terminal domains of the heavy or light chain of the antibody. The variable domains of the heavy chain and light chain may be referred to as "$V_H$" and "$V_L$", respectively. These domains are generally the most variable parts of the antibody (relative to other antibodies of the same class) and contain the antigen binding sites. Heavy-chain only antibodies from the Camelid species have a single heavy chain variable region, which is referred to as "$V_H$H". $V_H$H is thus a special type of $V_H$.

The term "variable" refers to the fact that certain segments of the variable domains differ extensively in sequence among antibodies. The V domain mediates antigen binding and defines the specificity of a particular antibody for its particular antigen. However, the variability is not evenly distributed across the entire span of the variable domains. Instead, it is concentrated in three segments called complementary determining regions (CDRs) or hypervariable regions (HVRs) both in the light-chain and the heavy chain variable domains. The more highly conserved portions of variable domains are called the framework regions (FR). The variable domains of native heavy and light chains each comprise four FR regions, largely adopting a beta-sheet configuration, connected by three CDRs, which form loops connecting, and in some cases forming part of, the beta-sheet structure. The CDRs in each chain are held together in close proximity by the FR regions and, with the CDRs from the other chain, contribute to the formation of the antigen binding site of antibodies (see Kabat et al., *Sequences of Immunological Interest*, Fifth Edition, National Institute of Health, Bethesda, Md. (1991)). The constant domains are not involved directly in the binding of antibody to an antigen, but exhibit various effector functions, such as participation of the antibody in antibody-dependent cellular toxicity.

The term "monoclonal antibody" as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site. In contrast to polyclonal antibody preparations which typically include different antibodies directed against different determinants (epitopes), each monoclonal antibody is directed against a single determinant on the antigen. In addition to their specificity, the monoclonal antibodies are advantageous in that they are synthesized by the hybridoma culture, uncontaminated by other immunoglobulins. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including, for example, the hybridoma method (e.g., Kohler and Milstein., *Nature,* 256:495-97 (1975); Hongo et al., *Hybridoma,* 14 (3): 253-260 (1995), Harlow et al., *Antibodies: A Laboratory Manual*, (Cold Spring Harbor Laboratory Press, $2^{nd}$ ed. 1988); Hammerling et al., in: *Monoclonal Antibodies and T-Cell Hybridomas* 563-681 (Elsevier, N.Y., 1981)), recombinant DNA methods (see, e.g., U.S. Pat. No. 4,816,567), phage-display technologies (see, e.g., Clackson et al., *Nature,* 352: 624-628 (1991); Marks et al., *J. Mol. Biol.* 222: 581-597 (1992); Sidhu et al., *J. Mol. Biol.* 338(2): 299-310 (2004); Lee et al., *J. Mol. Biol.* 340(5): 1073-1093 (2004); Fellouse, *Proc. Natl. Acad. Sci. USA* 101(34): 12467-12472 (2004); and Lee et al., *J. Immunol. Methods* 284(1-2): 119-132 (2004), and technologies for producing human or human-like antibodies in animals that have parts or all of the human immunoglobulin loci or genes encoding human immunoglobulin sequences (see, e.g., WO 1998/24893; WO 1996/34096; WO 1996/33735; WO 1991/10741; Jakobovits et al., *Proc. Natl. Acad. Sci. USA* 90: 2551 (1993); Jakobovits et al., *Nature* 362: 255-258 (1993); Bruggemann et al., *Year in Immunol.* 7:33 (1993); U.S. Pat. Nos. 5,545,807; 5,545,806; 5,569,825; 5,625,126; 5,633,425; and 5,661,016; Marks et al., *Bio/Technology* 10: 779-783 (1992); Lonberg et al., *Nature* 368: 856-859 (1994); Morrison, *Nature* 368: 812-813 (1994); Fishwild et al., *Nature Biotechnol.* 14: 845-851 (1996); Neuberger, *Nature Biotechnol.* 14: 826 (1996); and Lonberg and Huszar, *Intern. Rev. Immunol.* 13: 65-93 (1995).

The term "naked antibody" refers to an antibody that is not conjugated to a cytotoxic moiety or radiolabel.

The terms "full-length antibody", "intact antibody", or "whole antibody" are used interchangeably to refer to an antibody in its substantially intact form, as opposed to an antibody fragment. Specifically, full-length 4-chain antibodies include those with heavy and light chains including an Fc region. Full-length heavy-chain only antibodies include the heavy chain (such as $V_HH$) and an Fc region. The constant domains may be native sequence constant domains (e.g., human native sequence constant domains) or amino acid sequence variants thereof. In some cases, the intact antibody may have one or more effector functions.

An "antibody fragment" or "antigen-binding fragment" comprises a portion of an intact antibody, preferably the antigen binding and/or the variable region of the intact antibody. Examples of antibody fragments include, but are not limited to Fab, Fab', F(ab')$_2$ and Fv fragments; diabodies; linear antibodies (see U.S. Pat. No. 5,641,870, Example 2; Zapata et al., *Protein Eng.* 8(10): 1057-1062 (1995)); single-chain antibody molecules; single-domain antibodies (such as $V_HH$), and multispecific antibodies formed from antibody fragments. Papain digestion of antibodies produced two identical antigen-binding fragments, called "Fab" fragments, and a residual "Fc" fragment, a designation reflecting the ability to crystallize readily. The Fab fragment consists of an entire L chain along with the variable region domain of the H chain ($V_H$), and the first constant domain of one heavy chain ($C_H1$). Each Fab fragment is monovalent with respect to antigen binding, i.e., it has a single antigen-binding site. Pepsin treatment of an antibody yields a single large F(ab')$_2$ fragment which roughly corresponds to two disulfide linked Fab fragments having different antigen-binding activity and is still capable of cross-linking antigen. Fab' fragments differ from Fab fragments by having a few additional residues at the carboxy-terminus of the $C_H1$ domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The Fc fragment comprises the carboxy-terminal portions of both H chains held together by disulfides. The effector functions of antibodies are determined by sequences in the Fc region, the region which is also recognized by Fc receptors (FcR) found on certain types of cells.

The term "constant domain" refers to the portion of an immunoglobulin molecule having a more conserved amino acid sequence relative to the other portion of the immunoglobulin, the variable domain, which contains the antigen-binding site. The constant domain contains the $C_H1$, $C_H2$ and $C_H3$ domains (collectively, CH) of the heavy chain and the CHL (or CL) domain of the light chain.

The "light chains" of antibodies (immunoglobulins) from any mammalian species can be assigned to one of two clearly distinct types, called kappa ("κ") and lambda ("λ"), based on the amino acid sequences of their constant domains.

"Fv" is the minimum antibody fragment which contains a complete antigen-recognition and -binding site. This fragment consists of a dimer of one heavy- and one light-chain variable region domain in tight, non-covalent association. From the folding of these two domains emanate six hypervariable loops (3 loops each from the H and L chain) that contribute the amino acid residues for antigen binding and confer antigen binding specificity to the antibody. However, even a single variable domain (or half of an Fv comprising only three CDRs specific for an antigen) has the ability to recognize and bind antigen, although at a lower affinity than the entire binding site.

"Single-chain Fv" also abbreviated as "sFv" or "scFv" are antibody fragments that comprise the $V_H$ and $V_L$, antibody domains connected into a single polypeptide chain. Preferably, the sFv polypeptide further comprises a polypeptide linker between the $V_H$ and $V_L$, domains which enables the sFv to form the desired structure for antigen binding. For a review of the sFv, see Pluckthun in *The Pharmacology of Monoclonal Antibodies*, vol. 113, Rosenburg and Moore eds., Springer-Verlag, New York, pp. 269-315 (1994).

"Functional fragments" of the antibodies described herein comprise a portion of an intact antibody, generally including the antigen binding or variable region of the intact antibody or the Fc region of an antibody which retains or has modified FcR binding capability. Examples of antibody fragments include linear antibody, single-chain antibody molecules and multispecific antibodies formed from antibody fragments.

The term "diabodies" refers to small antibody fragments prepared by constructing sFv fragments (see preceding paragraph) with short linkers (about 5-10 residues) between the $V_H$ and $V_L$, domains such that inter-chain but not intra-chain pairing of the V domains is achieved, thereby resulting in a bivalent fragment, i.e., a fragment having two antigen-binding sites. Bispecific diabodies are heterodimers of two "crossover" sFv fragments in which the $V_H$ and $V_L$, domains of the two antibodies are present on different polypeptide chains. Diabodies are described in greater detail in, for example, EP 404,097; WO 93/11161; Hollinger et al., *Proc. Natl. Acad. Sci. USA* 90: 6444-6448 (1993).

The monoclonal antibodies herein specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is(are) identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., *Proc. Natl. Acad. Sci. USA,* 81:6851-6855 (1984)). "Humanized antibody" is used as a subset of "chimeric antibodies".

"Humanized" forms of non-human (e.g., llama or camelid) antibodies are chimeric antibodies that contain minimal sequence derived from non-human immunoglobulin. In some embodiments, a humanized antibody is a human immunoglobulin (recipient antibody) in which residues from an CDR (hereinafter defined) of the recipient are replaced by residues from an CDR of a non-human species (donor antibody) such as mouse, rat, rabbit, camel, llama, alpaca, or non-human primate having the desired specificity, affinity, and/or capacity. In some instances, framework ("FR") residues of the human immunoglobulin are replaced by corresponding non-human residues. Furthermore, humanized antibodies may comprise residues that are not found in the recipient antibody or in the donor antibody. These modifications may be made to further refine antibody performance, such as binding affinity. In general, a humanized antibody will comprise substantially all of at least one, and typically two, variable domains, in which all or substantially all of the hypervariable loops correspond to those of a non-human immunoglobulin sequence, and all or substantially all of the FR regions are those of a human immunoglobulin sequence, although the FR regions may include one or more individual FR residue substitutions that improve antibody performance, such as binding affinity, isomerization, immunogenicity, etc. The number of these amino acid substitutions in the FR is typically no more than 6 in the H chain, and in the L chain, no more than 3. The humanized antibody optionally will also comprise at least a portion of an immunoglobulin constant region (Fc), typically that of a human immunoglobulin. For further details, see, e.g., Jones et al., *Nature* 321:522-525 (1986); Riechmann et al., *Nature* 332:323-329 (1988); and Presta, *Curr. Op. Struct. Biol.* 2:593-596 (1992). See also, for example, Vaswani and Hamilton, *Ann. Allergy, Asthma & Immunol.* 1:105-115 (1998); Harris, *Biochem. Soc. Transactions* 23:1035-1038 (1995); Hurle and Gross, *Curr. Op. Biotech.* 5:428-433 (1994); and U.S. Pat. Nos. 6,982,321 and 7,087,409.

A "human antibody" is an antibody that possesses an amino-acid sequence corresponding to that of an antibody produced by a human and/or has been made using any of the techniques for making human antibodies as disclosed herein. This definition of a human antibody specifically excludes a humanized antibody comprising non-human antigen-binding residues. Human antibodies can be produced using various techniques known in the art, including phage-display libraries. Hoogenboom and Winter, *J. Mol. Biol.*, 227: 381 (1991); Marks et al., *J. Mol. Biol.*, 222:581 (1991). Also available for the preparation of human monoclonal antibodies are methods described in Cole et al., *Monoclonal Antibodies and Cancer Therapy*, Alan R. Liss, p. 77 (1985); Boerner et al., *J. Immunol.*, 147(1):86-95 (1991). See also van Dijk and van de Winkel, *Curr. Opin. Pharmacol.*, 5: 368-74 (2001). Human antibodies can be prepared by administering the antigen to a transgenic animal that has been modified to produce such antibodies in response to antigenic challenge, but whose endogenous loci have been disabled, e.g., immunized xenomice (see, e.g., U.S. Pat. Nos. 6,075,181 and 6,150,584 regarding XENOMOUSE™ technology). See also, for example, Li et al., *Proc. Natl. Acad. Sci. USA*, 103:3557-3562 (2006) regarding human antibodies generated via a human B-cell hybridoma technology.

The term "hypervariable region," "HVR," or "HV," when used herein refers to the regions of an antibody variable domain which are hypervariable in sequence and/or form structurally defined loops. Generally, single-domain antibodies comprise three HVRs (or CDRs): HVR1 (or CDR1), HVR2 (or CDR2), and HVR3 (or CDR3). HVR3 (or CDR3) displays the most diversity of the three HVRs, and is believed to play a unique role in conferring fine specificity to antibodies. See, e.g., Hamers-Casterman et al., *Nature* 363:446-448 (1993); Sheriff et al., *Nature Struct. Biol.* 3:733-736 (1996).

The term "Complementarity Determining Region" or "CDR" are used to refer to hypervariable regions as defined by the Kabat system. See Kabat et al., *Sequences of Proteins of Immunological Interest*, 5th Ed. Public Health Service, National Institutes of Health, Bethesda, Md. (1991).

A number of HVR delineations are in use and are encompassed herein. The Kabat Complementarity Determining Regions (CDRs) are based on sequence variability and are the most commonly used (Kabat et al., *Sequences of Proteins of Immunological Interest*, 5th Ed. Public Health Service, National Institutes of Health, Bethesda, Md. (1991)). Chothia refers instead to the location of the structural loops (Chothia and Lesk, *J. Mol. Biol.* 196:901-917 (1987)). The AbM HVRs represent a compromise between the Kabat HVRs and Chothia structural loops, and are used by Oxford Molecular's AbM antibody modeling software. The "contact" HVRs are based on an analysis of the available complex crystal structures. The residues from each of these HVRs are noted below in Table 1.

TABLE 1

HVR delineations.

| Loop | Kabat | AbM | Chothia | Contact |
|---|---|---|---|---|
| L1 | L24-L34 | L24-L34 | L26-L32 | L30-L36 |
| L2 | L50-L56 | L50-L56 | L50-L52 | L46-L55 |
| L3 | L89-L97 | L89-L97 | L91-L96 | L89-L96 |
| H1 | H31-H35B | H26-H35B | H26-H32 | H30-H35B |
| | | (Kabat Numbering) | | |
| H1 | H31-H35 | H26-H35 | H26-H32 | H30-H35 |
| | | (Chothia Numbering) | | |
| H2 | H50-H65 | H50-H58 | H53-H55 | H47-H58 |
| H3 | H95-H102 | H95-H102 | H96-H101 | H93-H101 |

HVRs may comprise "extended HVRs" as follows: 24-36 or 24-34 (L1), 46-56 or 50-56 (L2) and 89-97 or 89-96 (L3) in the $V_L$, and 26-35 (H1), 50-65 or 49-65 (H2) and 93-102, 94-102, or 95-102 (H3) in the $V_H$. The variable domain residues are numbered according to Kabat et al., supra, for each of these definitions.

The amino acid residues of a single-domain antibody (such as $V_H H$) are numbered according to the general numbering for VH domains given by Kabat et al. ("Sequence of proteins of immunological interest", US Public Health Services, NTH Bethesda, Md., Publication No. 91), as applied to $V_H H$ domains from Camelids in the article of Riechmann and Muyldermans, J. Immunol. Methods 2000 Jun. 23; 240 (1-2): 185-195. According to this numbering, FR1 of a $V_H H$ comprises the amino acid residues at positions 1-30, CDR1 of a $V_H H$ comprises the amino acid residues at positions 31-35, FR2 of a $V_H H$ comprises the amino acids at positions 36-49, CDR2 of a $V_H H$ comprises the amino acid residues at positions 50-65, FR3 of a $V_H H$ comprises the amino acid residues at positions 66-94, CDR3 of a $V_H H$ comprises the amino acid residues at positions 95-102, and FR4 of a $V_H H$ comprises the amino acid residues at positions 103-113. In this respect, it should be noted that—as is well known in the art for $V_H$ domains and for $V_H H$ domains—the total number of amino acid residues in each of the CDRs may vary and may not correspond to the total number of amino acid residues indicated by the Kabat numbering (that is, one or more positions according to the Kabat numbering may not be occupied in the actual sequence, or the actual sequence may contain more amino acid residues than the number allowed for by the Kabat numbering).

The expression "variable-domain residue-numbering as in Kabat" or "amino-acid-position numbering as in Kabat," and variations thereof, refers to the numbering system used for heavy-chain variable domains or light-chain variable domains of the compilation of antibodies in Kabat et al., supra. Using this numbering system, the actual linear amino acid sequence may contain fewer or additional amino acids corresponding to a shortening of, or insertion into, a FR or HVR of the variable domain. For example, a heavy-chain variable domain may include a single amino acid insert (residue 52a according to Kabat) after residue 52 of H2 and inserted residues (e.g. residues 82a, 82b, and 82c, etc. according to Kabat) after heavy-chain FR residue 82. The Kabat numbering of residues may be determined for a given antibody by alignment at regions of homology of the sequence of the antibody with a "standard" Kabat numbered sequence.

Unless indicated otherwise herein, the numbering of the residues in an immunoglobulin heavy chain is that of the EU index as in Kabat et al., supra. The "EU index as in Kabat" refers to the residue numbering of the human IgG1 EU antibody.

"Framework" or "FR" residues are those variable-domain residues other than the HVR residues as herein defined.

A "human consensus framework" or "acceptor human framework" is a framework that represents the most commonly occurring amino acid residues in a selection of human immunoglobulin $V_L$ or $V_H$ framework sequences. Generally, the selection of human immunoglobulin $V_L$ or $V_H$ sequences is from a subgroup of variable domain sequences. Generally, the subgroup of sequences is a subgroup as in Kabat et al., *Sequences of Proteins of Immunological Interest*, 5$^{th}$ Ed. Public Health Service, National Institutes of Health, Bethesda, Md. (1991). Examples include for the $V_L$, the subgroup may be subgroup kappa I, kappa II, kappa III or kappa IV as in Kabat et al., supra. Additionally, for the VH, the subgroup may be subgroup I, subgroup II, or subgroup III as in Kabat et al. Alternatively, a human consensus framework can be derived from the above in which particular residues, such as when a human framework residue is selected based on its homology to the donor framework by aligning the donor framework sequence with a collection of various human framework sequences. An acceptor human framework "derived from" a human immunoglobulin framework or a human consensus framework may comprise the same amino acid sequence thereof, or it may contain preexisting amino acid sequence changes. In some embodiments, the number of pre-existing amino acid changes are 10 or less, 9 or less, 8 or less, 7 or less, 6 or less, 5 or less, 4 or less, 3 or less, or 2 or less.

An "affinity-matured" antibody is one with one or more alterations in one or more CDRs thereof that result in an improvement in the affinity of the antibody for antigen, compared to a parent antibody that does not possess those alteration(s). In some embodiments, an affinity-matured antibody has nanomolar or even picomolar affinities for the target antigen. Affinity-matured antibodies are produced by procedures known in the art. For example, Marks et al., *Bio/Technology* 10:779-783 (1992) describes affinity maturation by $V_H$- and $V_L$-domain shuffling. Random mutagenesis of CDR and/or framework residues is described by, for example: Barbas et al. *Proc Nat. Acad. Sci. USA* 91:3809-3813 (1994); Schier et al. *Gene* 169:147-155 (1995); Yelton et al. *J. Immunol.* 155:1994-2004 (1995); Jackson et al., *J. Immunol.* 154(7):3310-9 (1995); and Hawkins et al, *J. Mol. Biol.* 226:889-896 (1992).

As use herein, the term "specifically binds," "specifically recognizes," or is "specific for" refers to measurable and reproducible interactions such as binding between a target and an antigen binding protein (such as a sdAb), which is determinative of the presence of the target in the presence of a heterogeneous population of molecules including biological molecules. For example, an antigen binding protein (such as a sdAb) that specifically binds a target (which can be an epitope) is an antigen binding protein (such as a sdAb) that binds this target with greater affinity, avidity, more readily, and/or with greater duration than it binds other targets. In some embodiments, the extent of binding of an antigen binding protein (such as a sdAb) to an unrelated target is less than about 10% of the binding of the antigen binding protein (such as a sdAb) to the target as measured, e.g., by a radioimmunoassay (RIA). In some embodiments, an antigen binding protein (such as a sdAb) that specifically binds a target has a dissociation constant ($K_d$) of $\leq 10^{-5}$ M, $\leq 10^{-6}$ M, $\leq 10^{-7}$ M, $\leq 10^{-8}$ M, $\leq 10^{-9}$ M, $\leq 10^{-10}$ M, $\leq 10^{-11}$ M, or $\leq 10^{-12}$ M. In some embodiments, an antigen binding protein specifically binds an epitope on a protein that is conserved among the protein from different species. In some embodiments, specific binding can include, but does not require exclusive binding.

The term "specificity" refers to selective recognition of an antigen binding protein (such as a sdAb) for a particular epitope of an antigen. Natural antibodies, for example, are monospecific. The term "multispecific" as used herein denotes that an antigen binding protein has polyepitopic specificity (i.e., is capable of specifically binding to two, three, or more, different epitopes on one biological molecule or is capable of specifically binding to epitopes on two, three, or more, different biological molecules). "Bispecific" as used herein denotes that an antigen binding protein has two different antigen-binding specificities. Unless otherwise indicated, the order in which the antigens bound by a bispecific antibody listed is arbitrary. That is, for example, the terms "anti-CTLA-4/PD-1," "anti-PD-1/CTLA-4," "CTLA-4×PD-1," "PD-1×CTLA-4," "PD-1/CTLA-4," "CTLA-4/PD-1," "PD-1-CTLA-4," and "CTLA-4-PD-1" may be used interchangeably to refer to bispecific antibodies that specifically bind to both CTLA-4 and PD-1. The term "monospecific" as used herein denotes an antigen binding protein (such as a sdAb) that has one or more binding sites each of which bind the same epitope of the same antigen.

The term "valent" as used herein denotes the presence of a specified number of binding sites in an antigen binding protein. A natural antibody for example or a full length antibody has two binding sites and is bivalent. As such, the terms "trivalent", "tetravalent", "pentavalent" and "hexavalent" denote the presence of two binding site, three binding sites, four binding sites, five binding sites, and six binding sites, respectively, in an antigen binding protein.

"Antibody effector functions" refer to those biological activities attributable to the Fc region (a native sequence Fc region or amino acid sequence variant Fc region) of an antibody, and vary with the antibody isotype. Examples of antibody effector functions include: C1q binding and complement dependent cytotoxicity; Fc receptor binding; antibody—dependent cell-mediated cytotoxicity (ADCC); phagocytosis; down regulation of cell surface receptors (e.g., B cell receptors); and B cell activation. "Reduced or minimized" antibody effector function means that which is reduced by at least 50% (alternatively 60%, 65%, 70%, 75%, 80%, 85%, 90%, 95%, 96%, 97%, 98%, 99%) from the wild type or unmodified antibody. The determination of antibody effector function is readily determinable and measurable by one of ordinary skill in the art. In a preferred embodiment, the antibody effector functions of complement binding, complement dependent cytotoxicity and antibody dependent cytotoxicity are affected. In some embodiments, effector function is eliminated through a mutation in the constant region that eliminated glycosylation, e.g., "effectorless mutation." In one aspect, the effector-less mutation is an N297A or DANA mutation (D265A+N297A) in the $C_H2$ region. Shields et al., *J. Biol. Chem.* 276 (9): 6591-6604 (2001). Alternatively, additional mutations resulting in reduced or eliminated effector function include: K322A and L234A/L235A (LALA). Alternatively, effector function can be reduced or eliminated through production techniques, such as expression in host cells that do not glycosylate (e.g., *E. coli.*) or in which result in an altered glycosylation pattern that is ineffective or less effective at promoting effector function (e.g., Shinkawa et al., *J. Biol. Chem.* 278(5): 3466-3473 (2003).

"Antibody-dependent cell-mediated cytotoxicity" or ADCC refers to a form of cytotoxicity in which secreted Ig bound onto Fc receptors (FcRs) present on certain cytotoxic cells (e.g., natural killer (NK) cells, neutrophils and macrophages) enable these cytotoxic effector cells to bind specifically to an antigen-bearing target cell and subsequently kill the target cell with cytotoxins. The antibodies "arm" the cytotoxic cells and are required for killing of the target cell by this mechanism. The primary cells for mediating ADCC, NK cells, express FcγRIII only, whereas monocytes express FcγRI, FcγRII and FcγRIII Fc expression on hematopoietic cells is summarized in Table 3 on page 464 of Ravetch and Kinet, *Annu. Rev. Immunol.* 9: 457-92 (1991). To assess ADCC activity of a molecule of interest, an in vitro ADCC assay, such as that described in U.S. Pat. No. 5,500,362 or 5,821,337 may be performed. Useful effector cells for such assays include peripheral blood mononuclear cells (PBMC) and natural killer (NK) cells. Alternatively, or additionally, ADCC activity of the molecule of interest may be assessed in vivo, e.g., in an animal model such as that disclosed in Clynes et al., *PNAS USA* 95:652-656 (1998).

The term "Fc region" herein is used to define a C-terminal region of an immunoglobulin heavy chain, including native-sequence Fc regions and variant Fc regions. Although the boundaries of the Fc region of an immunoglobulin heavy chain might vary, the human IgG heavy-chain Fc region is usually defined to stretch from an amino acid residue at position Cys226, or from Pro230, to the carboxyl-terminus thereof. The C-terminal lysine (residue 447 according to the EU numbering system) of the Fc region may be removed, for example, during production or purification of the antibody, or by recombinantly engineering the nucleic acid encoding a heavy chain of the antibody. Accordingly, a composition of intact antibodies may comprise antibody populations with all K447 residues removed, antibody populations with no K447 residues removed, and antibody populations having a mixture of antibodies with and without the K447 residue. Suitable native-sequence Fc regions for use in the antibodies described herein include human IgG1, IgG2 (IgG2A, IgG2B), IgG3 and IgG4.

"Fc receptor" or "FcR" describes a receptor that binds the Fc region of an antibody. The preferred FcR is a native sequence human FcR. Moreover, a preferred FcR is one which binds an IgG antibody (a gamma receptor) and includes receptors of the FcγRI, FcγRII, and FcγRIII subclasses, including allelic variants and alternatively spliced forms of these receptors, FcγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain. (See M. Daëron, *Annu. Rev. Immunol.* 15:203-234 (1997). FcRs are reviewed in Ravetch and Kinet, *Annu. Rev. Immunol.* 9: 457-92 (1991); Capel et al., *Immunomethods* 4: 25-34 (1994); and de Haas et al., *J. Lab. Clin. Med.* 126: 330-41 (1995). Other FcRs, including those to be identified in the future, are encompassed by the term "FcR" herein.

The term "Fc receptor" or "FcR" also includes the neonatal receptor, FcRn, which is responsible for the transfer of maternal IgGs to the fetus. Guyer et al., *J. Immunol.* 117: 587 (1976) and Kim et al., *J. Immunol.* 24: 249 (1994). Methods of measuring binding to FcRn are known (see, e.g., Ghetie and Ward, *Immunol. Today* 18: (12): 592-8 (1997); Ghetie et al., *Nature Biotechnology* 15 (7): 637-40 (1997); Hinton et al., *J. Biol. Chem.* 279 (8): 6213-6 (2004); WO 2004/92219 (Hinton et al.). Binding to FcRn in vivo and serum half-life of human FcRn high-affinity binding polypeptides can be assayed, e.g., in transgenic mice or transfected human cell lines expressing human FcRn, or in primates to which the polypeptides having a variant Fc region are administered. WO 2004/42072 (Presta) describes antibody variants which improved or diminished binding to FcRs. See also, e.g., Shields et al., *J. Biol. Chem.* 9(2): 6591-6604 (2001).

"Complement dependent cytotoxicity" or "CDC" refers to the lysis of a target cell in the presence of complement. Activation of the classical complement pathway is initiated by the binding of the first component of the complement system (C1q) to antibodies (of the appropriate subclass) which are bound to their cognate antigen. To assess complement activation, a CDC assay, e.g., as described in Gazzano-Santoro et al., *J. Immunol. Methods* 202: 163 (1996), may be performed. Antibody variants with altered Fc region amino acid sequences and increased or decreased C1q binding capability are described in U.S. Pat. No. 6,194,551B1 and WO99/51642. The contents of those patent publications are specifically incorporated herein by reference. See, also, Idusogie et al., *J. Immunol.* 164: 4178-4184 (2000).

"Binding affinity" generally refers to the strength of the sum total of non-covalent interactions between a single binding site of a molecule (e.g., an antibody) and its binding partner (e.g., an antigen). Unless indicated otherwise, as used herein, "binding affinity" refers to intrinsic binding affinity that reflects a 1:1 interaction between members of a binding pair. Binding affinity can be indicated by $K_d$, $K_{off}$, $K_{on}$, or $K_a$. The term "$K_{off}$", as used herein, is intended to refer to the off rate constant for dissociation of an antibody (or antigen-binding domain) from the antibody/antigen complex, as determined from a kinetic selection set up, expressed in units of $s^{-1}$. The term "$K_{on}$", as used herein, is intended to refer to the on rate constant for association of an antibody (or antigen-binding domain) to the antigen to form the antibody/antigen complex, expressed in units of $M^{-1} s^{-1}$. The term equilibrium dissociation constant "$K_D$" or "$K_d$", as used herein, refers to the dissociation constant of a particular antibody-antigen interaction, and describes the concentration of antigen required to occupy one half of all of the antibody-binding domains present in a solution of antibody molecules at equilibrium, and is equal to $K_{off}/K_{on}$, expressed in units of M. The measurement of $K_d$ presupposes that all binding agents are in solution. In the case where the antibody is tethered to a cell wall, e.g., in a yeast expression system, the corresponding equilibrium rate constant is expressed as EC50, which gives a good approximation of $K_d$. The affinity constant, $K_a$, is the inverse of the dissociation constant, $K_d$, expressed in units of $M^{-1}$.

The dissociation constant ($K_D$ or $K_d$) is used as an indicator showing affinity of antibodies to antigens. For example, easy analysis is possible by the Scatchard method using antibodies marked with a variety of marker agents, as well as by using BiacoreX (made by Amersham Biosciences), which is an over-the-counter, measuring kit, or similar kit, according to the user's manual and experiment operation method attached with the kit. The $K_D$ value that can be derived using these methods is expressed in units of M (Mols). An antibody or antigen-binding fragment thereof that specifically binds to a target may have a dissociation constant ($K_d$) of, for example, $\leq 10^{-5}$ M, $\leq 10^{-6}$ M, $\leq 10^{-7}$ M, $\leq 10^{-8}$ M, $\leq 10^{-9}$ M, $\leq 10^{-10}$ M, $\leq 10^{-11}$ M, or $\leq 10^{-12}$ M.

Binding specificity of the antibody or antigen-binding domain can be determined experimentally by methods known in the art. Such methods comprise, but are not limited to Western blots, ELISA-, RIA-, ECL-, IRMA-, EIA-, BIAcore-tests and peptide scans.

Half maximal inhibitory concentration ($IC_{50}$) is a measure of the effectiveness of a substance (such as an antibody) in inhibiting a specific biological or biochemical function. It indicates how much of a particular drug or other substance (inhibitor, such as an antibody) is needed to inhibit a given biological process (e.g., the binding between CTLA-4 and B7-1, or component of a process, i.e. an enzyme, cell, cell receptor or microorganism) by half. The values are typically expressed as molar concentration. $IC_{50}$ is comparable to an $EC_{50}$ for agonist drug or other substance (such as an antibody). $EC_{50}$ also represents the plasma concentration required for obtaining 50% of a maximum effect in vivo. As used herein, an "$IC_{50}$" is used to indicate the effective concentration of an antibody (such as an anti-CTLA-4 sdAb) needed to neutralize 50% of the antigen bioactivity (such as CTLA-4 bioactivity) in vitro. $IC_{50}$ or $EC_{50}$ can be measured by bioassays such as inhibition of ligand binding by FACS analysis (competition binding assay), cell based cytokine release assay, or amplified luminescent proximity homogeneous assay (AlphaLISA).

"Percent (%) amino acid sequence identity" and "homology" with respect to a peptide, polypeptide or antibody sequence are defined as the percentage of amino acid residues in a candidate sequence that are identical with the amino acid residues in the specific peptide or polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or MEGALIGN™ (DNASTAR) software. Those skilled in the art can determine appropriate parameters for measuring alignment, including any algorithms needed to achieve maximal alignment over the full length of the sequences being compared.

An "isolated" nucleic acid molecule encoding a construct, antibody, or antigen-binding fragment thereof described herein is a nucleic acid molecule that is identified and separated from at least one contaminant nucleic acid molecule with which it is ordinarily associated in the environment in which it was produced. Preferably, the isolated nucleic acid is free of association with all components associated with the production environment. The isolated nucleic acid molecules encoding the polypeptides and antibodies described herein is in a form other than in the form or setting in which it is found in nature. Isolated nucleic acid molecules therefore are distinguished from nucleic acid encoding the polypeptides and antibodies described herein existing naturally in cells. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors."

As used herein, the term "autologous" is meant to refer to any material derived from the same individual to whom it is later to be re-introduced into the individual.

"Allogeneic" refers to a graft derived from a different individual of the same species.

The term "transfected" or "transformed" or "transduced" as used herein refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

"Adjuvant setting" refers to a clinical setting in which an individual has had a history of cancer, and generally (but not necessarily) been responsive to therapy, which includes, but is not limited to, surgery (e.g., surgery resection), radiotherapy, and chemotherapy. However, because of their history of cancer, these individuals are considered at risk of development of the disease. Treatment or administration in the "adjuvant setting" refers to a subsequent mode of treatment. The degree of risk (e.g., when an individual in the adjuvant setting is considered as "high risk" or "low risk") depends upon several factors, most usually the extent of disease when first treated.

"Neoadjuvant setting" refers to a clinical setting in which the method is carried out before the primary/definitive therapy.

The term "pharmaceutical formulation" of "pharmaceutical composition" refers to a preparation that is in such form as to permit the biological activity of the active ingredient to be effective, and that contains no additional components that are unacceptably toxic to a subject to which the formulation would be administered. Such formulations are sterile. A "sterile" formulation is aseptic or free from all living microorganisms and their spores.

It is understood that embodiments of the invention described herein include "consisting" and/or "consisting essentially of" embodiments.

Reference to "about" a value or parameter herein includes (and describes) variations that are directed to that value or parameter per se. For example, description referring to "about X" includes description of "X".

As used herein, reference to "not" a value or parameter generally means and describes "other than" a value or parameter. For example, the method is not used to treat cancer of type X means the method is used to treat cancer of types other than X.

The term "about X-Y" used herein has the same meaning as "about X to about Y."

As used herein and in the appended claims, the singular forms "a," "or," and "the" include plural referents unless the context clearly dictates otherwise.

II. Anti-CTLA-4 Construct (I) Anti-CTLA-4 Single-Domain Antibody Moiety

The isolated anti-CTLA-4 construct described herein comprises a single-domain antibody (sdAb) moiety that specifically recognizes CTLA-4 (or "anti-CTLA-4 sdAb"). In some embodiments, the isolated anti-CTLA-4 construct is an anti-CTLA-4 sdAb.

In some embodiments, there is provided an anti-CTLA-4 sdAb moiety comprising a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, the anti-CTLA-4 sdAb moiety comprises a CDR3 comprising the amino acid sequence of any one of SEQ ID NOs: 81-96 and 253-262, and the amino acid substitutions are in CDR1 and/or CDR2.

Thus, in some embodiments, there is provided an anti-CTLA-4 sdAb moiety comprising a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions, wherein the amino acid substitutions are in CDR1 and/or CDR2. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

The sequences of the CDRs noted herein are provided in Table 2 and Table 6 below.

TABLE 2

Anti-CTLA-4 sdAb SEQ ID NOs

| Construct name | SEQ ID NO:FR1 | SEQ ID NO:CDR1 | SEQ ID NO:FR2 | SEQ ID NO:CDR2 | SEQ ID NO:FR3 | SEQ ID NO:CDR3 | SEQ ID NO:FR4 |
|---|---|---|---|---|---|---|---|
| A34310 | 1 QVQLVESGGGLVQAGGSLRLSCAAS | 17 GFTFDDYAIG | 33 WFRQAPGKEREGVS | 49 CISSGGTYYADSVKG | 65 RFTISSDNAKNTVFLQMNSLKPEDTAVYYCGA | 81 VSSLLSVERFPGGHCGPRYGYYRHGY | 165 WGQGTQVTVSS |

TABLE 2-continued

Anti-CTLA-4 sdAb SEQ ID NOs

| Construct name | SEQ ID NO:FR1 | SEQ ID NO:CDR1 | SEQ ID NO:FR2 | SEQ ID NO:CDR2 | SEQ ID NO:FR3 | SEQ ID NO:CDR3 | SEQ ID NO:FR4 |
|---|---|---|---|---|---|---|---|
| A34311 | 2 QVKLEESGGGLVLPGESLRLSCEAS | 18 GRTITTITMG | 34 WFRQAPGKERQFVA | 50 SHSWTDNNPYYADSVKG | 66 RFIISRDNAGNRVYLQMHSLEPEDTAVYYCAA | 82 TARRSFVGRQWYTEARQYDY | 165 WGQGTQVTVSS |
| A34313 | 3 QVQLVESGGGLVQAGGSLRLSCATS | 19 VRTPLSNFAMG | 35 WFRQTPGKEREFVA | 51 AISRSGGSTSYADSVKG | 67 RFTISRDNAKNTVYLEMNSLKGEDTVVYYCAA | 83 KIAGMNNIVFIGAPQYNY | 165 WGQGTQVTVSS |
| A34625 | 4 QVKLEESGGGLVQPGGSLRLSCVAS | 20 GSIDSTYTMG | 36 WYRQAPGKQRELVA | 52 SITSSGSTNHADSVKG | 68 RFTISRDNAKNTVYLQMNTLKPEDAAVYYCRY | 84 LSVLSAY | 165 WGQGTQVTVSS |
| A36566 | 5 EVQLVESGGGLVQVGDSLRLSCAAS | 21 GRSFENYAIG | 37 WFRQAPGKEREFVA | 53 TISWIPRTAYSTTYYADSVKG | 69 RFTISGDNSKNTVYLQMTSLKPEDTAVYYCAA | 85 GGATGPLALDSHYGY | 165 WGQGTQVTVSS |
| A36922 | 6 QVQLVESGGGLVQAGGSLRLSCAAS | 22 GRLSRTFTMG | 38 WYRQAPGKQRDLVA | 54 SITTSGSTNYADSVKG | 70 RFTISRDNAKNTVILQMNSLVPEDTAVYYCRF | 86 LSASTAA | 166 WGQGTQVTIST |
| A37067 | 7 AVQLVDSGGGLVQAGGSLRLSCAAS | 23 GSISSLNAMA | 39 WYRQGPGKERELVA | 55 SITRGGSTAYTDSVKG | 71 RFTISRDNAKNTVYLQMNSLKPEDTAVYYCRA | 87 VWGFGDYGS | 165 WGQGTQVTVSS |
| AS07014 | 8 QVHLVESGGSVQAGGSLRLSCAAS | 24 GYTYSRHCLG | 40 WFRQTPGKEREAVA | 56 TIDSDGSTSYADSVKG | 72 RFTISSDNAKNTLYLQMNSLKPEDTAMYYCAI | 88 GPNPRYCSGAPNTRGAEHYFGY | 167 WAQGTQVTVSS |
| AS07172 | 9 QVKLVESGGGSVQAGGSLRLSCAVS | 25 GDDLSNYCMG | 41 WVRQAPGKEREEVA | 57 TIDYAFKTNYADSVKG | 73 RFTISKDNAENSLRVNLEMNDLKPDDTAMYYCAA | 89 DWSSGGVCFGLADFGT | 168 RGQGTQVTVSS |
| AS07189 | 10 QVQLVESGGGSVQAGGSLRLSCAAS | 26 GDSPSVNYMG | 42 WFRRAPEKQREQREEVA | 58 SIYPTGGTFYTDSVKG | 74 RFTISRDNAKNTLYLQMTALKPEDTAMYYCAA | 90 GKWGTDY | 169 WGQGTQVIVSS |
| AS07392 | 11 QVKLVESGGGSVQAGGSLRLSCAAS | 27 GDSYSVKYMG | 43 WFRRAPGKQRDQREEVA | 59 SIYPTGGTFYTDSVKG | 75 RFTISRDNAKSTLYLQMTALKPEDTAMYYCAA | 91 GKWGTDY | 165 WGQGTQVTVSS |
| AS07678 | 12 QVHLMESGGGSVQAGGSLRLSCAAS | 28 GYTYSRYCLG | 44 WFRQTPGKEREAVA | 60 TIDIDGSTSYADSVKG | 76 RFTISNDNAKNTLYLQMNILKPEDTAMYYCAA | 92 GPNPRYCSGAVYTRGAEHYFGY | 165 WGQGTQVTVSS |
| AS07688 | 13 QIQLVESGGGSVQAGGSLRLSCAAS | 29 GDSYSVNYMG | 45 WFRRAPGQQREQREEVA | 61 SIYATGGTFYRDSVKG | 77 RFTISRDNAKNTLYLQMTALKPEDTAMYYCAA | 93 GKWGTDY | 169 WGQGTQVIVSS |
| AS07712 | 14 QIQLVESGGGSVQAGGSLRLSCAAS | 30 AYTDRRYCMA | 46 WFRQAPGKEREGVA | 62 TMDTDGSTRYADSVKG | 78 RFTISTDSAKNTLYLQMNSLEPEDTAMYYCAV | 94 GPNPRYCSGAINTRGAEHYFGY | 165 WGQGTQVTVSS |
| AS07745 | 15 QMQLVESGGGLVQPGGSLRLSCAAS | 31 GFTFSSYYMS | 47 WVRQAPGKGLEWVS | 63 SIYSDGSNTYYADSVKG | 79 RFTISRDNAKNTVYLQMNSLKSEDTALYYCAT | 95 PRGAHGPTYCSGGYCY | 170 GGQGTQVTVSS |
| AS07832 | 16 QVQLVESGGGSVQAGGSLRLSCAAS | 32 GYYNRYCLG | 48 WFRQTPGKEREAVA | 64 TIDTDGSTSYADSVKG | 80 RFTISFDNAKNTLYLQMNSLKPEDTAMYYCAA | 96 GPNPRYCSGAVNTRGAEHYFGY | 167 WAQGTQVTVSS |

TABLE 6

Anti-CTLA-4 sdAb SEQ ID NOs

| Construct name | SEQ ID NO: FR1 | | SEQ ID NO: CDR1 | | SEQ ID NO: FR2 | | SEQ ID NO: CDR2 | | SEQ ID NO: FR3 | | SEQ ID NO: CDR3 | | SEQ ID NO: FR4 |
|---|---|---|---|---|---|---|---|---|---|---|---|---|---|
| AS02640 | 203 | QVQLVESGGGVVQPGRSLRLSCAAS | 213 | GRTITTITMG | 223 | WFRQAPGKGLEFVA | 233 | SHSWTDNNPYYADSVKG | 243 | RFIISRDNSKNRLYLQMNSLRAEDTAVYYCAA | 253 | TARRSFVGRQWYTEARQYDY | 263 | WGQGTLVTVSS |
| A34311VH11 | 204 | EVQLVESGGGVVQPGRSLRLSCAAS | 214 | GRTITTITMG | 224 | WFRQAPGKGREFVA | 234 | SHSWTDNNPYYADSVKG | 244 | RFTISRDNAKNTLYLQMNSLRPEDTAVYYCAA | 254 | TARRSFVGRQWYTEARQYDY | 263 | WGQGTLVTVSS |
| AS07014VH11 | 205 | EVQLVESGGGLVQPGGSLRLSCAAS | 215 | GYTYSRHCLG | 225 | WFRQAPGKGREAVS | 235 | TIDSDGSTSYADSVKG | 245 | RFTISRDNAKNTLYLQMNSLRPEDTAVYYCAI | 255 | GPNPRYCSGAPNTRGAEHYFGY | 263 | WGQGTLVTVSS |
| AS07014VH11G54 | 206 | EVQLVESGGGLVQPGGSLRLSCAAS | 216 | GYTYSRHCLG | 226 | WFRQAPGKGREAVS | 236 | TIDSGGSTSYADSVKG | 246 | RFTISRDNAKNTLYLQMNSLRPEDTAVYYCAI | 256 | GPNPRYCSGAPNTRGAEHYFGY | 263 | WGQGTLVTVSS |
| AS07014VH11SGA | 207 | EVQLVESGGGLVQPGGSLRLSCAAS | 217 | GYTYSRHCLG | 227 | WFRQAPGKGREAVS | 237 | TISSGGSTSYADSVKG | 247 | RFTISRDNAKNTLYLQMNSLRPEDTAVYYCAI | 257 | GPNPRYCSGAPATRGAEHYFGY | 263 | WGQGTLVTVSS |
| AS07014VH11SGQ | 208 | EVQLVESGGGLVQPGGSLRLSCAAS | 218 | GYTYSRHCLG | 228 | WFRQAPGKGREAVS | 238 | TISSGGSTSYADSVKG | 248 | RFTISRDNAKNTLYLQMNSLRPEDTAVYYCAI | 258 | GPNPRYCSGAPQTRGAEHYFGY | 263 | WGQGTLVTVSS |
| AS07014VH11SGS | 209 | EVQLVESGGGLVQPGGSLRLSCAAS | 219 | GYTYSRHCLG | 229 | WFRQAPGKGREAVS | 239 | TISSGGSTSYADSVKG | 249 | RFTISRDNAKNTLYLQMNSLRPEDTAVYYCAI | 259 | GPNPRYCSGAPSTRGAEHYFGY | 263 | WGQGTLVTVSS |
| AS07189TKDVH11 | 210 | EVQLVESGGGLVQPGGSLRLSCAAS | 220 | GDSPSVNYMG | 230 | WFRQAPGKGREEVS | 240 | SIYPTGGTFYTDSVKG | 250 | RFTISRDNAKNTLYLQMNSLRPEDTAVYYCAA | 260 | GKWGTDY | 263 | WGQGTLVTVSS |
| AS07189TKDVH11F27 | 211 | EVQLVESGGGLVQPGGSLRLSCAAS | 221 | GFSPSVNYMG | 231 | WFRQAPGKGREEVS | 241 | SIYPTGGTFYTDSVKG | 251 | RFTISRDNAKNTLYLQMNSLRPEDTAVYYCAA | 261 | GKWGTDY | 263 | WGQGTLVTVSS |
| AS07189TKDVH11FY | 212 | EVQLVESGGGLVQPGGSLRLSCAAS | 222 | GFSPSVNYMG | 232 | WFRQAPGKGREEVS | 242 | SIYPTGGTFYTDSVKG | 252 | RFTISRDNAKNTLYLQMNSLRPEDTAVYYCAA | 262 | GKYGTDY | 263 | WGQGTLVTVSS |
| AS07189TKDVH21FY | 212 | EVQLVESGGGLVQPGGSLRLSCAAS | 222 | GFSPSVNYMG | 338 | WVRQAPGKGLEEVS | 242 | SIYPTGGTFYTDSVKG | 340 | RFTISRDNSKNTLYLQMNSLRAEDTAVYYCAA | 262 | GKYGTDY | 263 | WGQGTLVTVSS |
| A34311VH2 | 204 | EVQLVESGGGVVQPGRSLRLSCAAS | 214 | GRTITTITMG | 223 | WFRQAPGKGLEFVA | 234 | SHSWTDNNPYYADSVKG | 340 | RFTISRDNSKNTLYLQMNSLRAEDTAVYYCAA | 254 | TARRSFVGRQWYTEARQYDY | 263 | WGQGTLVTVSS |
| A34311VH2F53 | 204 | EVQLVESGGGVVQPGRSLRLSCAAS | 214 | GRTITTITMG | 223 | WFRQAPGKGLEFVA | 339 | SHSFTDNNPYYADSVKG | 340 | RFTISRDNSKNTLYLQMNSLRAEDTAVYYCAA | 254 | TARRSFVGRQWYTEARQYDY | 263 | WGQGTLVTVSS |
| A34311VH11F53 | 204 | EVQLVESGGGVVQPGRSLRLSCAAS | 214 | GRTITTITMG | 224 | WFRQAPGKGREFVA | 339 | SHSFTDNNPYYADSVKG | 252 | RFTISRDNAKNTLYLQMNSLRPEDTAVYYCAA | 254 | TARRSFVGRQWYTEARQYDY | 263 | WGQGTLVTVSS |
| AS07014 direct grafted | 205 | EVQLVESGGGLVQPGGSLRLSCAAS | 24 | GYTYSRHCLG | 350 | WVRQAPGKGLEWVS | 56 | TIDSDGSTSYADSVKG | 351 | RFTISRDNSKNTLYLQMNSLRAEDTAVYYCAR | 88 | GPNPRYCSGAPNTRGAEHYFGY | 263 | WGQGTLVTVSS |
| AS07189 direct grafted | 210 | EVQLVESTGGGLVQPGGSLRLSCAAS | 26 | GDSPSVNYMG | 350 | WVRQAPGKGLEWVS | 58 | SIYPTGGTFYTDSVKG | 351 | RFTISRDNSKNTLYLQMNSLRAEDTAVYYCAR | 90 | GKWGTDY | 263 | WGQGTLVTVSS |

The CDRs can be combined in various pair-wise combinations to generate a number of anti-CTLA-4 sdAb moieties.

For example, in some embodiments, there is provided an anti-CTLA-4 sdAb moiety comprising a CDR1 comprising the amino acid sequence of SEQ ID NO: 17, or a variant thereof comprising up to about 3 (such as about any of 1, 2, or 3) amino acid substitutions; a CDR2 comprising the amino acid sequence of SEQ ID NO: 49, or a variant thereof comprising up to about 3 (such as about any of 1, 2, or 3) amino acid substitutions; and a CDR3 comprising the amino acid sequence of SEQ ID NO: 81, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 17; a CDR2 comprising the amino acid sequence of SEQ ID NO: 49; and a CDR3 comprising the amino acid sequence of SEQ ID NO: 81; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 17; a CDR2 comprising the amino acid sequence of SEQ ID NO: 49; and a CDR3 comprising the amino acid sequence of SEQ ID NO: 81. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$M, or about $10^{-8}$M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 18, or a variant thereof comprising up to about 3 (such as about any of 1, 2, or 3) amino acid substitutions; a CDR2 comprising the amino acid sequence of SEQ ID NO: 50, or a variant thereof comprising up to about 3 (such as about any of 1, 2, or 3) amino acid substitutions; and a CDR3 comprising the amino acid sequence of SEQ ID NO: 82, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 18; a CDR2 comprising the amino acid sequence of SEQ ID NO: 50; and a CDR3 comprising the amino acid sequence of SEQ ID NO: 82; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 18; a CDR2 comprising the amino acid sequence of SEQ ID NO: 50; and a CDR3 comprising the amino acid sequence of SEQ ID NO: 82. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$M, or about $10^{-8}$M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 19, or a variant thereof comprising up to about 3 (such as about any of 1, 2, or 3) amino acid substitutions; a CDR2 comprising the amino acid sequence of SEQ ID NO: 51, or a variant thereof comprising up to about 3 (such as about any of 1, 2, or 3) amino acid substitutions; and a CDR3 comprising the amino acid sequence of SEQ ID NO: 83, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 19; a CDR2 comprising the amino acid sequence of SEQ ID NO: 51; and a CDR3 comprising the amino acid sequence of SEQ ID NO: 83; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 19; a CDR2 comprising the amino acid sequence of SEQ ID NO: 51; and a CDR3 comprising the amino acid sequence of SEQ ID NO: 83. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 20, or a variant thereof comprising up to about 3 (such as about any of 1, 2, or 3) amino acid substitutions; a CDR2 comprising the amino acid sequence of SEQ ID NO: 52, or a variant thereof comprising up to about 3 (such as about any of 1, 2, or 3) amino acid substitutions; and a CDR3 comprising the amino acid sequence of SEQ ID NO: 84, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 20; a CDR2 comprising the amino acid sequence of SEQ ID NO: 52; and a CDR3 comprising the amino acid sequence of SEQ ID NO: 84; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 20; a CDR2 comprising the amino acid sequence of SEQ ID NO: 52; and a CDR3 comprising the amino acid sequence of SEQ ID NO: 84. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 21, or a variant thereof comprising up to about 3 (such as about any of 1, 2, or 3) amino acid substitutions; a CDR2 comprising the amino acid sequence of SEQ ID NO: 53, or a variant thereof comprising up to about 3 (such as about any of 1, 2, or 3) amino acid substitutions; and a CDR3 comprising the amino acid sequence of SEQ ID NO: 85, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 21; a CDR2 comprising the amino acid sequence of SEQ ID NO: 53; and a CDR3 comprising the amino acid sequence of SEQ ID NO: 85; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 21; a CDR2 comprising the amino acid sequence of SEQ ID NO: 53; and a CDR3 comprising the amino acid sequence of SEQ ID NO: 85. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 22, or a variant thereof comprising up to about 3 (such as about any of 1, 2, or 3) amino acid substitutions; a CDR2 comprising the amino acid sequence of SEQ ID NO: 54, or a variant thereof comprising up to about 3 (such as about any of 1, 2, or 3) amino acid substitutions; and a CDR3 comprising the amino acid sequence of SEQ ID NO: 86, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 22; a CDR2 comprising the amino acid sequence of SEQ ID NO: 54; and a CDR3 comprising the amino acid sequence of SEQ ID NO: 86; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 22; a CDR2 comprising the amino acid sequence of SEQ ID NO: 54; and a CDR3 comprising the amino acid sequence of SEQ ID NO: 86. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 23, or a variant thereof comprising up to about 3 (such as about any of 1, 2, or 3) amino acid substitutions; a CDR2 comprising the amino acid sequence of SEQ ID NO: 55, or a variant thereof comprising up to about 3 (such as about any of 1, 2, or 3) amino acid substitutions; and a CDR3 comprising the amino acid sequence of SEQ ID NO: 87, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 23; a CDR2 comprising the amino acid sequence of SEQ ID NO: 55; and a CDR3 comprising the amino acid sequence of SEQ ID NO: 87; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 23; a CDR2 comprising the amino acid sequence of SEQ ID NO: 55; and a CDR3 comprising the amino acid sequence of SEQ ID NO: 87. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 24, or a variant thereof comprising up to about 3 (such as about any of 1, 2, or 3) amino acid substitutions; a CDR2 comprising the amino acid sequence of SEQ ID NO: 56, or a variant thereof comprising up to about 3 (such as about any of 1, 2, or 3) amino acid substitutions; and a CDR3 comprising the amino acid sequence of SEQ ID NO: 88, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 24; a CDR2 comprising the amino acid sequence of SEQ ID NO: 56; and a CDR3 comprising the amino acid sequence of SEQ ID NO: 88; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 24; a CDR2 comprising the amino acid sequence of SEQ ID NO: 56; and a CDR3 comprising the amino acid sequence of SEQ ID NO: 88. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 25, or a variant thereof comprising up to about 3 (such as about any of 1, 2, or 3) amino acid substitutions; a CDR2 comprising the amino acid sequence of SEQ ID NO: 57, or a variant thereof comprising up to about 3 (such as about any of 1, 2, or 3) amino acid substitutions; and a CDR3 comprising the amino acid sequence of SEQ ID NO: 89, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 25; a CDR2 comprising the amino acid sequence of SEQ ID NO: 57; and a CDR3 comprising the amino acid sequence of SEQ ID NO: 89; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 25; a CDR2 comprising the amino acid sequence of SEQ ID NO: 57; and a CDR3 comprising the amino acid sequence of SEQ ID NO: 89. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 26, or a variant thereof comprising up to about 3 (such as about any of 1, 2, or 3) amino acid substitutions; a CDR2 comprising the amino acid sequence of SEQ ID NO: 58, or a variant thereof comprising up to about 3 (such as about any of 1, 2, or 3) amino acid substitutions; and a CDR3 comprising the amino acid sequence of SEQ ID NO: 90, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 26; a CDR2 comprising the amino acid sequence of SEQ ID NO: 58; and a CDR3 comprising the amino acid sequence of SEQ ID NO: 90; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 26; a CDR2 comprising the amino acid sequence of SEQ ID NO: 58; and a CDR3 comprising the amino acid sequence of SEQ ID NO: 90. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 27, or a variant thereof comprising up to about 3 (such as about any of 1, 2, or 3) amino acid substitutions; a CDR2 comprising the amino acid sequence of SEQ ID NO: 59, or a variant thereof comprising up to about 3 (such as about any of 1, 2, or 3) amino acid substitutions; and a CDR3 comprising the amino acid sequence of SEQ ID NO: 91, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 27; a CDR2 comprising the amino acid sequence of SEQ ID NO: 59; and a CDR3 comprising the amino acid sequence of SEQ ID NO: 91; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 27; a CDR2 comprising the amino acid sequence of SEQ ID NO: 59; and a CDR3 comprising the amino acid sequence of SEQ ID NO: 91. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 28, or a variant thereof comprising up to about 3 (such as about any of 1, 2, or 3) amino acid substitutions; a CDR2 comprising the amino acid sequence of SEQ ID NO: 60, or a variant thereof comprising up to about 3 (such as about any of 1, 2, or 3) amino acid substitutions; and a CDR3 comprising the amino acid sequence of SEQ ID NO: 92, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 28; a CDR2 comprising the amino acid sequence of SEQ ID NO: 60; and a CDR3 comprising the amino acid sequence of SEQ ID NO: 92; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 28; a CDR2 comprising the amino acid sequence of SEQ ID NO: 60; and a CDR3 comprising the amino acid sequence of SEQ ID NO: 92. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 29, or a variant thereof comprising up to about 3 (such as about any of 1, 2, or 3) amino acid substitutions; a CDR2 comprising the amino acid sequence of SEQ ID NO: 61, or a variant thereof comprising up to about 3 (such as about any of 1, 2, or 3) amino acid substitutions; and a CDR3 comprising the amino acid sequence of SEQ ID NO: 93, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 29; a CDR2 comprising the amino acid sequence of SEQ ID NO: 61; and a CDR3 comprising the amino acid sequence of SEQ ID NO: 93; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 29; a CDR2 comprising the amino acid sequence of SEQ ID NO: 61; and a CDR3 comprising the amino acid sequence of SEQ ID NO: 93. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 30, or a variant thereof comprising up to about 3 (such as about any of 1, 2, or 3) amino acid substitutions; a CDR2 comprising the amino acid sequence of SEQ ID NO: 62, or a variant thereof comprising up to about 3 (such as about any of 1, 2, or 3) amino acid substitutions; and a CDR3 comprising the amino acid sequence of SEQ ID NO: 94, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 30; a CDR2 comprising the amino acid sequence of SEQ ID NO: 62; and a CDR3 comprising the amino acid sequence of SEQ ID NO: 94; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 30; a CDR2 comprising the amino acid sequence of SEQ ID NO: 62; and a CDR3 comprising the amino acid sequence of SEQ ID NO: 94. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 31, or a variant thereof comprising up to about 3 (such as about any of 1, 2, or 3) amino acid substitutions; a CDR2 comprising the amino acid sequence of SEQ ID NO: 63, or a variant thereof comprising up to about 3 (such as about any of 1, 2, or 3) amino acid substitutions; and a CDR3 comprising the amino acid sequence of SEQ ID NO: 95, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 31; a CDR2 comprising the amino acid sequence of SEQ ID NO: 63; and a CDR3 comprising the amino acid sequence of SEQ ID NO: 95; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 31; a CDR2 comprising the amino acid sequence of SEQ ID NO: 63; and a CDR3 comprising the amino acid sequence of SEQ ID NO: 95. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 32, or a variant thereof comprising up to about 3 (such as about any of 1, 2, or 3) amino acid substitutions; a CDR2 comprising the amino acid sequence of SEQ ID NO: 64, or a variant thereof comprising up to about 3 (such as about any of 1, 2, or 3) amino acid substitutions; and a CDR3 comprising the amino acid sequence of SEQ ID NO: 96, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 32; a CDR2 comprising the amino acid sequence of SEQ ID NO: 64; and a CDR3 comprising the amino acid sequence of SEQ ID NO: 96; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 32; a CDR2 comprising the amino acid sequence of SEQ ID NO: 64; and a CDR3 comprising the amino acid sequence of SEQ ID NO: 96. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 213, or a variant thereof comprising up to about 3 (such as about any of 1, 2, or 3) amino acid substitutions; a CDR2 comprising the amino acid sequence of SEQ ID NO: 233, or a variant thereof comprising up to about 3 (such as about any of 1, 2, or 3) amino acid substitutions; and a CDR3 comprising the amino acid sequence of SEQ ID NO: 253, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 213; a CDR2 comprising the amino acid sequence of SEQ ID NO: 233; and a CDR3 comprising the amino acid sequence of SEQ ID NO: 253; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 213; a CDR2 comprising the amino acid sequence of SEQ ID NO: 233; and a CDR3 comprising the amino acid sequence of SEQ ID NO: 253. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 214, or a variant thereof comprising up to about 3 (such as about any of 1, 2, or 3) amino acid substitutions; a CDR2 comprising the amino acid sequence of SEQ ID NO: 234, or a variant thereof comprising up to about 3 (such as about any of 1, 2, or 3) amino acid substitutions; and a CDR3 comprising the amino acid sequence of SEQ ID NO: 254, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 214; a CDR2 comprising the amino acid sequence of SEQ ID NO: 234; and a CDR3 comprising the amino acid sequence of SEQ ID NO: 254; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 214; a CDR2 comprising the amino acid sequence of SEQ ID NO: 234; and a CDR3 comprising the amino acid sequence of SEQ ID NO: 254. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 215, or a variant thereof comprising up to about 3 (such as about any of 1, 2, or 3) amino acid substitutions; a CDR2 comprising the amino acid sequence of SEQ ID NO: 235, or a variant thereof comprising up to about 3 (such as about any of 1, 2, or 3) amino acid substitutions; and a CDR3 comprising the amino acid sequence of SEQ ID NO: 255, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 215; a CDR2 comprising the amino acid sequence of SEQ ID NO: 235; and a CDR3 comprising the amino acid sequence of SEQ ID NO: 255; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 215; a CDR2 comprising the amino acid sequence of SEQ ID NO: 235; and a CDR3 comprising the amino acid sequence of SEQ ID NO: 255. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 216, or a variant thereof comprising up to about 3 (such as about any of 1, 2, or 3) amino acid substitutions; a CDR2 comprising the amino acid sequence of SEQ ID NO: 236, or a variant thereof comprising up to about 3 (such as about any of 1, 2, or 3) amino acid substitutions; and a CDR3 comprising the amino acid sequence of SEQ ID NO: 256, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 216; a CDR2 comprising the amino acid sequence of SEQ ID NO: 236; and a CDR3 comprising the amino acid sequence of SEQ ID NO: 256; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 216; a CDR2 comprising the amino acid sequence of SEQ ID NO: 236; and a CDR3 comprising the amino acid sequence of SEQ ID NO: 256. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 217, or a variant thereof comprising up to about 3 (such as about any of 1, 2, or 3) amino acid substitutions; a CDR2 comprising the amino acid sequence of SEQ ID NO: 237, or a variant thereof comprising up to about 3 (such as about any of 1, 2, or 3) amino acid substitutions; and a CDR3 comprising the amino acid sequence of SEQ ID NO: 257, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 217; a CDR2 comprising the amino acid sequence of SEQ ID NO: 237; and a CDR3 comprising the amino acid sequence of SEQ ID NO: 257; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 217; a CDR2 comprising the amino acid sequence of SEQ ID NO: 237; and a CDR3 comprising the amino acid sequence of SEQ ID NO: 257. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 218, or a variant thereof comprising up to about 3 (such as about any of 1, 2, or 3) amino acid substitutions; a CDR2 comprising the amino acid sequence of SEQ ID NO: 238, or a variant thereof comprising up to about 3 (such as about any of 1, 2, or 3) amino acid substitutions; and a CDR3 comprising the amino acid sequence of SEQ ID NO: 258, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 218; a CDR2 comprising the amino acid sequence of SEQ ID NO: 238; and a CDR3 comprising the amino acid sequence of SEQ ID NO: 258; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 218; a CDR2 comprising the amino acid sequence of SEQ ID NO: 238; and a CDR3 comprising the amino acid sequence of SEQ ID NO: 258. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 219, or a variant thereof comprising up to about 3 (such as about any of 1, 2, or 3) amino acid substitutions; a CDR2 comprising the amino acid sequence of SEQ ID NO: 239, or a variant thereof comprising up to about 3 (such as about any of 1, 2, or 3) amino acid substitutions; and a CDR3 comprising the amino acid sequence of SEQ ID NO: 259, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 219; a CDR2 comprising the amino acid sequence of SEQ ID NO: 239; and a CDR3 comprising the amino acid sequence of SEQ ID NO: 259; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 219; a CDR2 comprising the amino acid sequence of SEQ ID NO: 239; and a CDR3 comprising the amino acid sequence of SEQ ID NO: 259. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 220, or a variant thereof comprising up to about 3 (such as about any of 1, 2, or 3) amino acid substitutions; a CDR2 comprising the amino acid sequence of SEQ ID NO: 240, or a variant thereof comprising up to about 3 (such as about any of 1, 2, or 3) amino acid substitutions; and a CDR3 comprising the amino acid sequence of SEQ ID NO: 260, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 220; a CDR2 comprising the amino acid sequence of SEQ ID NO: 240; and a CDR3 comprising the amino acid sequence of SEQ ID NO: 260; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 220; a CDR2 comprising the amino acid sequence of SEQ ID NO: 240; and a CDR3 comprising the amino acid sequence of SEQ ID NO: 260. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 221, or a variant thereof comprising up to about 3 (such as about any of 1, 2, or 3) amino acid substitutions; a CDR2 comprising the amino acid sequence of SEQ ID NO: 241, or a variant thereof comprising up to about 3 (such as about any of 1, 2, or 3) amino acid substitutions; and a CDR3 comprising the amino acid sequence of SEQ ID NO: 261, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 221; a CDR2 comprising the amino acid sequence of SEQ ID NO: 241; and a CDR3 comprising the amino acid sequence of SEQ ID NO: 261; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 221; a CDR2 comprising the amino acid sequence of SEQ ID NO: 241; and a CDR3 comprising the amino acid sequence of SEQ ID NO: 261. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 222, or a variant thereof comprising up to about 3 (such as about any of 1, 2, or 3) amino acid substitutions; a CDR2 comprising the amino acid sequence of SEQ ID NO: 242, or a variant thereof comprising up to about 3 (such as about any of 1, 2, or 3) amino acid substitutions; and a CDR3 comprising the amino acid sequence of SEQ ID NO: 262, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 222; a CDR2 comprising the amino acid sequence of SEQ ID NO: 242; and a CDR3 comprising the amino acid sequence of SEQ ID NO: 262; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 222; a CDR2 comprising the amino acid sequence of SEQ ID NO: 242; and a CDR3 comprising the amino acid sequence of SEQ ID NO: 262. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 sdAb moiety comprising a CDR1 comprising the amino acid sequence of SEQ ID NO: 214, or a variant thereof comprising up to about 3 (such as about any of 1, 2, or 3) amino acid substitutions; a CDR2 comprising the amino acid sequence of SEQ ID NO: 339, or a variant thereof comprising up to about 3 (such as about any of 1, 2, or 3) amino acid substitutions; and a CDR3 comprising the amino acid sequence of SEQ ID NO: 254, or a variant thereof comprising up to about 3 (such as about any of 1, 2, or 3) amino acid substitutions. In some embodiments, there is provided an anti-CTLA-4 sdAb moiety comprising a CDR1 comprising the amino acid sequence of SEQ ID NO: 214; a CDR2 comprising the amino acid sequence of SEQ ID NO: 339; and a CDR3 comprising the amino acid sequence of SEQ ID NO: 254; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an anti-CTLA-4 sdAb moiety comprising a CDR1 comprising the amino acid sequence of SEQ ID NO: 214; a CDR2 comprising the amino acid sequence of SEQ ID NO: 339; and a CDR3 comprising the amino acid sequence of SEQ ID NO: 254. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

The anti-CTLA-4 sdAb moiety may comprise one or more "hallmark residues" in one or more of the FR sequences. In some embodiments, the anti-CTLA-4 sdAb moiety may comprise a $V_HH$ domain comprising the amino acid sequence of any one of the following: a-1) the amino acid residue at position 37 is selected from the group consisting of F, Y, V, L, A, H, S, I, W, C, N, G, D, T, and P (such as F, Y, L, I, or V, such as F or Y, or such as F); a-2) the amino acid residue at position 44 is selected from the group consisting of E, Q, G, D, A, K, R, L, P, S, V, H, T, N, W, M, and I (such as A, G, E, D, Q, R, S, or L, or such as G, E, or Q); a-3) the amino acid residue at position 45 is selected from the group consisting of L, R, P, H, F, G, Q, S, E, T, Y, C, I, D, and V (such as L, C, or R, or such as L or R); a-4) the amino acid residue at position 103 is selected from the group consisting of W, R, G, S, K, A, M, Y, I, F, T, N, V, Q, P, E, and C (such as W, G, or R, or such as W); and a-5) the amino acid residue at position 108 is selected from the group consisting of Q, L, R, P, E, K, S, T, M, A, and H (such as Q); or b-1) the amino acid residue at position 37 is selected from the group consisting of F, Y, L, I, and V (such as F or Y, or such as F); b-2) the amino acid residue at position 44 is selected from the group consisting of E and Q; b-3) the amino acid residue at position 45 is selected from the group consisting of L and R (such as R); b-4) the amino acid residue at position 103 is selected from the group consisting of G, W, R and S (such as W); and b-5) the amino acid residue at position 108 is selected from the group consisting of Q and L (such as Q); or c-1) the amino acid residue at position 37 is selected from the group consisting of F, Y, L, I, and V (such as F or Y, or such as F); c-2) the amino acid residue at position 44 is selected from the group consisting of A, G, E, D, Q, R, S and L (such as G, E, or Q); c-3) the amino acid residue at position 45 is selected from the group consisting of L, R and C (such as L or R); c-4) the amino acid residue at position 103 is selected from the group consisting of P, R and S (such as R or S); and c-5) the amino acid residue at position 108 is selected from the group consisting of Q and L (such as Q); wherein the amino acid position is according to Kabat numbering. It should be noted that these "hallmark residues" at amino acid positions 37, 44, 45, 103 and 108 according to Kabat numbering apply to anti-CTLA-4 sdAb moieties of natural $V_HH$ sequences, and can be substituted during humanization. For example, Q at amino acid position 108 according to Kabat numbering can be optionally humanized to L. Other humanized substitutions will be clear to those skilled in the art. For example, potentially useful humanizing substitutions can be determined by comparing the FR sequences of a naturally occurring $V_HH$ with the corresponding FR sequences of one or more closely related human $V_H$, then introducing one or more of such potentially useful humanizing substitutions into said $V_HH$ using methods known in the art (also as described herein). The resulting humanized $V_HH$ sequences can be tested for their CTLA-4 binding affinity, for stability, for ease and level of expression, and/or for other desired properties. Possible residue substitutions may also come from an antibody $V_H$ domain wherein the VH/VL interface comprises one or more highly charged amino acid residues. The anti-CTLA-4 sdAb moiety described herein can be partially or fully humanized. Preferably, the resulting humanized anti-CTLA-4 sdAb binds to CTLA-4 with $K_d$, $K_{on}$, $K_{off}$ described herein.

In some embodiments, there is provided an anti-CTLA-4 sdAb moiety comprising a $V_HH$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353. In some embodiments, there is provided an anti-CTLA-4 sdAb moiety comprising a $V_HH$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_HH$ domain. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353, or a variant thereof comprises amino acid substitutions in CDRs, such as the CDR1, and/or the CDR2, and/or the CDR3 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353, or a variant thereof comprises CDR1, CDR2, and CDR3 of any one of SEQ ID NOs: 113-129, 200-202, 274-282, 341-344, 352, and 353, and the amino acid substitutions are in FRs, such as the FR1, and/or the FR2, and/or the FR3, and/or the FR4 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353, or a variant thereof comprises amino acid substitutions in both CDRs and FRs. In some embodiments, there is provided an anti-CTLA-4 sdAb moiety comprising a $V_HH$ domain comprising the amino acid sequence of any one of SEQ ID NOs: 113-129, 200-202, 274-282, 341-344, 352, and 353. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized. In some embodiments, the anti-CTLA-4 sdAb moiety is humanized based on an anti-CTLA-4 sdAb moiety comprising the amino acid sequence of SEQ ID: 114. In some embodiments, the humanized anti-CTLA-4 sdAb moiety comprises the amino acid sequence of any one of SEQ ID NOs: 129, 201, 202, 274, and 342-344. In some embodiments, the anti-CTLA-4 sdAb moiety is humanized based on an anti-CTLA-4 sdAb moiety comprising the amino acid sequence of SEQ ID: 120. In some embodiments, the humanized anti-CTLA-4 sdAb moiety comprises the amino acid sequence of any one of SEQ ID NOs: 275-279. In some embodiments, the anti-CTLA-4 sdAb moiety is humanized based on an anti-CTLA-4 sdAb moiety comprising the amino acid sequence of SEQ ID: 122. In some embodiments, the humanized anti-CTLA-4 sdAb moiety comprises the amino acid sequence of SEQ ID NOs: 280-282 and 341.

In some embodiments, there is provided an anti-CTLA-4 sdAb moiety (hereinafter referred to as "competing anti-CTLA-4 sdAb moiety" or "competing anti-CTLA-4 sdAb") or anti-CTLA-4 construct comprising an anti-CTLA-4 sdAb moiety (hereinafter referred to as "competing anti-CTLA-4 construct") that specifically binds to CTLA-4 competitively with any one of the anti-CTLA-4 sdAb moiety described herein. In some embodiments, competitive binding may be determined using an ELISA assay. For example, in some embodiments, there is provided an anti-CTLA-4 sdAb moiety (or an anti-CTLA-4 construct comprising an anti-CTLA-4 sdAb moiety) that specifically binds to CTLA-4 competitively with an anti-CTLA-4 sdAb moiety comprising the amino acid sequence of any one of SEQ ID NOs: 113-129, 200-202, 274-282, 341-344, 352, and 353. For another example, in some embodiments, there is provided an anti-CTLA-4 sdAb moiety (or an anti-CTLA-4 construct comprising an anti-CTLA-4 sdAb moiety) that specifically binds to CTLA-4 competitively with an anti-CTLA-4 sdAb moiety comprising a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the $K_d$ of the binding between the competing anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the competing anti-CTLA-4 sdAb moiety is camelid, chimeric, human, partially humanized, or fully humanized.

In some embodiments, there is provided an anti-CTLA-4 sdAb moiety comprising CDR1, CDR2, and CDR3 of any one of SEQ ID NOs: 113-129, 200-202, 274-282, 341-344, 352, and 353. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

Single-Domain Antibodies

Exemplary sdAbs include, but are not limited to, heavy chain variable domains from heavy-chain only antibodies (e.g., $V_HH$ (Variable domain of the heavy chain of the Heavy chain antibody) in Camelidae or $V_{NAR}$ (Variable domain of the shark New Antigen Receptor) in cartilaginous fish), binding molecules naturally devoid of light chains, single domains (such as $V_H$ or $V_L$) derived from conventional 4-chain antibodies, humanized heavy-chain only antibodies, human single-domain antibodies produced by transgenic mice or rats expressing human heavy chain segments, and engineered domains and single domain scaffolds other than those derived from antibodies. The sdAbs may be derived from any species including, but not limited to mouse, rat, human, camel, llama, lamprey, fish, shark, goat, rabbit, and bovine. Single-domain antibodies contemplated herein also include naturally occurring single-domain antibody molecules from species other than Camelidae and sharks.

In some embodiments, the sdAb is derived from a naturally occurring single-domain antigen binding molecule known as heavy chain antibody devoid of light chains (also referred herein as "heavy chain-only antibodies", or "HCAb"). Such single domain molecules are disclosed in WO 94/04678 and Hamers-Casterman, C. et al. (1993) Nature 363:446-448, for example. For clarity reasons, the variable domain derived from a heavy chain molecule naturally devoid of light chain is known herein as a $V_HH$ to distinguish it from the conventional VH of four chain immunoglobulins. Such a $V_HH$ molecule can be derived from antibodies raised in Camelidae species, for example, camel, llama, vicuna, dromedary, alpaca and guanaco. Other species besides Camelidae may produce heavy chain molecules naturally devoid of light chain, and such $V_HH$s are within the scope of the present application.

In some embodiments, the sdAb is derived from a variable region of the immunoglobulin found in cartilaginous fish. For example, the sdAb can be derived from the immunoglobulin isotype known as Novel Antigen Receptor (NAR) found in the serum of shark. Methods of producing single domain molecules derived from a variable region of NAR ("IgNARs") are described in WO 03/014161 and Streltsov (2005) Protein Sci. 14:2901-2909.

In some embodiments, the sdAb is recombinant, CDR-grafted, humanized, camelized, de-immunized and/or in vitro generated (e.g., selected by phage display). In some embodiments, the amino acid sequence of the framework regions may be altered by "camelization" of specific amino acid residues in the framework regions. Camelization refers to the replacing or substitution of one or more amino acid residues in the amino acid sequence of a (naturally occurring) VH domain from a conventional 4-chain antibody by one or more of the amino acid residues that occur at the corresponding position(s) in a $V_HH$ domain of a heavy chain antibody. This can be performed in a manner known per se, which will be clear to the skilled person, for example on the basis of the further description herein. Such "camelizing" substitutions are preferably inserted at amino acid positions that form and/or are present at the VH-VL interface, and/or at the so-called Camelidae hallmark residues, as defined herein (see for example WO 94/04678, Davies and Riechmann FEBS Letters 339: 285-290, 1994; Davies and Riechmann Protein Engineering 9 (6): 531-537, 1996; Riechmann J. Mol. Biol. 259: 957-969, 1996; and Riechmann and Muyldermans J. Immunol. Meth. 231: 25-38, 1999).

In some embodiments, the sdAb is a human sdAb produced by transgenic mice or rats expressing human heavy chain segments. See, e.g., US20090307787A1, U.S. Pat. No. 8,754,287, US20150289489A1, US20100122358A1, and WO2004049794. In some embodiments, the sdAb is affinity matured.

In some embodiments, naturally occurring $V_HH$ domains against a particular antigen or target, can be obtained from (naïve or immune) libraries of Camelid $V_{HH}$ sequences. Such methods may or may not involve screening such a library using said antigen or target, or at least one part, fragment, antigenic determinant or epitope thereof using one or more screening techniques known per se. Such libraries and techniques are for example described in WO 99/37681, WO 01/90190, WO 03/025020 and WO 03/035694. Alternatively, improved synthetic or semi-synthetic libraries derived from (naïve or immune) $V_HH$ libraries may be used, such as $V_{HH}$ libraries obtained from (naïve or immune) $V_HH$ libraries by techniques such as random mutagenesis and/or CDR shuffling, as for example described in WO 00/43507.

In some embodiments, the sdAbs are generated from conventional four-chain antibodies. See, for example, EP 0 368 684, Ward et al. (Nature 1989 Oct. 12; 341 (6242): 544-6), Holt et al., Trends Biotechnol., 2003, 21(11):484-490; WO 06/030220; and WO 06/003388.

Because of the unique properties of sdAbs, using $V_HH$ domains as single antigen-binding proteins or as antigen-binding domains (i.e. as part of a larger protein or polypeptide) offers a number of significant advantages over the conventional $V_H$ and $V_L$, scFv and conventional antibody fragments (such as Fab or (Fab')2): 1) only a single domain is required to bind an antigen with high affinity, so there is no need to have a second domain, nor to assure that these two domains are present in the correct spatial conformation and configuration (e.g. no need to pair the heavy chain and light chain during folding, no need to use a specially designed linker such as for scFv); 2) $V_HH$ domains and other sdAbs can be expressed from a single gene and require no post-translational folding or modifications; 3) $V_HH$ domains and other sdAbs can be easily engineered into multivalent and/or multispecific formats (such as those described in the present application); 4) $V_HH$ domains and other sdAbs are highly soluble and do not have a tendency to aggregate (as with the mouse-derived "dAbs" described by Ward et al., Nature. 1989 Oct. 12; 341(6242):544-6); 5) $V_HH$ domains and other sdAbs are highly stable against heat, pH, proteases and other denaturing agents or conditions; 6) $V_HH$ domains and other sdAbs are easy and relatively cheap to prepare (even on a large production scale), such as using microbial fermentation, there is no need to use mammalian expression system (required by production of, for example, conventional antibody fragments); 7) $V_HH$ domains and other sdAbs are relatively small (approximately 15 kDa, or 10 times smaller than a conventional IgG) compared to conventional 4-chain antibodies and antigen-binding fragments thereof, thus have high(er) tissue penetration ability, such as for solid tumors and other dense tissues; and 8) $V_HH$ domains and other sdAbs can exhibit so-called "cavity-binding properties" (due to their extended CDR3 loop compared to that of conventional $V_H$ domains) and can therefore access targets and epitopes not accessible to conventional 4-chain antibodies and antigen-binding fragments thereof, for example, it has been shown that $V_HH$ domains and other sdAbs can inhibit enzymes (see for example WO1997049805; Transue et al., Proteins. 1998 Sep. 1; 32(4):515-22; Lauwereys et al., EMBO J. 1998 Jul. 1; 17(13):3512-20).

CTLA-4

CTLA-4 contains an extracellular V domain, a transmembrane domain, and a cytoplasmic tail. Several isoforms encoded by alternate splice variants have been characterized. The membrane-bound isoform functions as a homodimer interconnected by a disulfide bond, while the soluble isoform functions as a monomer. CTLA-4 has an intracellular domain similar to that of CD28, which lacks intrinsic catalytic activity and contains one YVKM motif able to bind PI3K, PP2A and SHP-2 and one proline-rich motif able to bind SH3 containing proteins.

The amino acid sequence of human CTLA-4 is disclosed at Genbank Accession Number NP_005205. The region of amino acids 1-37 is the leader peptide; 38-161 is the extracellular V-like domain; 162-187 is the transmembrane domain; and 188-223 is the cytoplasmic domain. The nucleotide sequence of human CTLA-4 mRNA is disclosed at NM_005214. Variants of the nucleotide sequence have been reported, including a G to A transition at position 49, a C to T transition at position 272, and an A to G transition at position 439.

A particular human CTLA-4 sequence will generally be at least 90% identical in amino acids sequence to human CTLA-4 of Genbank Accession Number NP_005205 and contains amino acid residues that identify the amino acid sequence as being human when compared to CTLA-4 amino acid sequences of other species (e.g., murine). In some embodiments, a human CTLA-4 may be at least about 95%, 96%, 97%, 98%, or 99% identical in amino acid sequence to CTLA-4 of Genbank Accession Number NP_005205. In some embodiments, a human CTLA-4 sequence will display no more than 10 amino acid differences from the CTLA-4 of Genbank Accession Number NP_005205. In some embodiments, the human CTLA-4 may display no more than 5, 4, 3, 2, or 1 amino acid difference from the CTLA-4 of Genbank Accession Number NP_005205. Percent identity can be determined as described herein. In some embodiments, the anti-CTLA-4 sdAb moiety described herein specifically recognizes a CTLA-4 polypeptide with 100% amino acid sequence identity to the CTLA-4 of Genbank Accession Number NP_005205. In some embodiments, the anti-CTLA-4 sdAb moiety specifically recognizes a CTLA-4 polypeptide comprising an amino acid sequence of SEQ ID NO: 199.

In some embodiments, the anti-CTLA-4 sdAb moiety may cross-react with CTLA-4 from species other than human, or other proteins which are structurally related to human CTLA-4 (e.g., human CTLA-4 homologs). In some embodiments, the anti-CTLA-4 sdAb moiety is completely specific for human CTLA-4 and not exhibit species or other types of cross-reactivity. In some embodiments, the anti-CTLA-4 sdAb moiety specifically recognizes a soluble isoform of human CTLA-4. In some embodiments, the anti-CTLA-4 sdAb moiety specifically recognizes a membrane-bound isoform of human CTLA-4.

In some embodiments, the anti-CTLA-4 sdAb moiety described herein specifically recognizes the extracellular domain (ECD) of CTLA-4. In some embodiments, the anti-CTLA-4 sdAb moiety specifically recognizes the N-terminal portion of the CTLA-4 extracellular domain (ECD). In some embodiments, the anti-CTLA-4 sdAb moiety specifically recognizes the C-terminal portion of the CTLA-4 extracellular domain (ECD). In some embodiments, the anti-CTLA-4 sdAb moiety specifically recognizes the middle portion of the CTLA-4 extracellular domain (ECD). In some embodiments, the extracellular domain of CTLA-4 specifically recognized by the anti-CTLA-4 sdAb moiety is at least about 95%, 96%, 97%, 98%, or 99% identical in amino acid sequence to the extracellular domain of the CTLA-4 of Genbank Accession Number NP_005205. In some embodiments, the extracellular domain of CTLA-4 specifically recognized by the anti-CTLA-4 sdAb moiety is 100% identical in amino acid sequence to the extracellular domain of the CTLA-4 of Genbank Accession Number NP_005205. In some embodiments, the anti-CTLA-4 sdAb moiety specifically recognizes a CTLA-4 polypeptide comprising an amino acid sequence of SEQ ID NO: 164.

Antibody Affinity

Binding specificity of the antibody or antigen-binding domain can be determined experimentally by methods known in the art. Such methods comprise, but are not limited to Western blots, ELISA-, RIA-, ECL-, IRMA-, EIA-, BIAcore-tests and peptide scans.

In some embodiments, the $K_d$ of the binding between the anti-CTLA-4 sdAb moiety and CTLA-4 is about $10^{-5}$ M to about $10^{-6}$ M, about $10^{-6}$ M to about $10^{-7}$ M, about $10^{-7}$ M to about $10^{-8}$ M, about $10^{-8}$ M to about $10^{-9}$ M, about $10^{-9}$ M to about $10^{-10}$ M, about $10^{-10}$ M to about $10^{-11}$ M, about $10^{-11}$ M to about $10^{-12}$ M, about $10^{-5}$ M to about $10^{-12}$ M, about $10^{-6}$ M to about $10^{-12}$ M, about $10^{-7}$ M to about $10^{-12}$ M, about $10^{-8}$ M to about $10^{-12}$ M, about $10^{-9}$ M to about $10^{-12}$ M, about $10^{-10}$ M to about $10^{-12}$ M, about $10^{-5}$ M to about $10^{-11}$ M, about $10^{-7}$ M to about $10^{-11}$ M, about $10^{-8}$ M to about $10^{-11}$ M, about $10^{-9}$ M to about $10^{-11}$ M, about $10^{-5}$ M to about $10^{-10}$ M, about $10^{-7}$ M to about $10^{-10}$ M, about $10^{-8}$ M to about $10^{-10}$ M, about $10^{-5}$ M to about $10^{-9}$ M, about $10^{-7}$ M to about $10^{-9}$ M, about $10^{-5}$ M to about $10^{-8}$ M, or about $10^{-6}$ M to about $10^{-8}$M.

In some embodiments, the $K_{on}$ of the binding between the anti-CTLA-4 sdAb moiety and CTLA-4 is about $10^2$ $M^{-1}$ $s^{-1}$ to about $10^4$ $M^{-1}$ $s^{-1}$, about $10^4$ $M^{-1}$ $s^{-1}$ to about $10^6$ $M^{-1}$ $s^{-1}$, about $10^6$ $M^{-1}$ $s^{-1}$ to about $10^7$ $M^{-1}$ $s^{-1}$, about $10^2$ $M^{-1}$ $s^{-1}$ to about $10^7$ $M^{-1}$ $s^{-1}$, about $10^3$ $M^{-1}$ $s^{-1}$ to about $10^7$ $M^{-1}$ $s^{-1}$, about $10^4$ $M^{-1}$ $s^{-1}$ to about $10^7$ $M^{-1}$ $s^{-1}$, about $10^5$ $M^{-1}$ $s^{-1}$ to about $10^7$ $M^{-1}$ $s^{-1}$, about $10^3$ $M^{-1}$ $s^{-1}$ to about $10^6$ $M^{-1}$ $s^{-1}$, or about $10^4$ $M^{-1}$ $s^{-1}$ to about $10^6$ $M^{-1}$ $s^{-1}$.

In some embodiments, the $K_{off}$ of the binding between the anti-CTLA-4 sdAb moiety and CTLA-4 is about 1 $s^{-1}$ to about $10^{-2}$ $s^{-1}$, about $10^{-2}$ $s^{-1}$ to about $10^{-4}$ $s^{-1}$, about $10^{-4}$ $s^{-1}$ to about $10^{-5}$ $s^{-1}$, about $10^{-5}$ $s^{-1}$ to about $10^{-6}$ $s^{-1}$, about 1 $s^{-1}$ to about $10^{-6}$ $s^{-1}$, about $10^{-2}$ $s^{-1}$ to about $10^{-6}$ $s^{-1}$, about $10^{-3}$ s$^{-1}$ to about $10^{-6}$ s$^{-1}$, about $10^{-4}$ s$^{-1}$ to about $10^{-6}$ s$^{-1}$, about $10^{-2}$ s$^{-1}$ to about $10^{-5}$ s$^{-1}$, or about $10^{-3}$ s$^{-1}$ to about $10^{-5}$ s$^{-1}$.

In some embodiments, the IC$_{50}$ of the anti-CTLA-4 sdAb moiety is less than 10 nM in an amplified luminescent proximity homogeneous assay (AlphaLISA) with 0.12 nM B7-1 and 0.2 nM CTLA-4. In some embodiments, the IC$_{50}$ of the anti-CTLA-4 sdAb moiety is less than 500 nM in an inhibition of ligand binding by FACS analysis (competition binding assay), or cell based cytokine release assay. In some embodiments, the IC$_{50}$ of the anti-CTLA-4 sdAb moiety is less than 1 nM, about 1 nM to about 10 nM, about 10 nM to about 50 nM, about 50 nM to about 100 nM, about 100 nM to about 200 nM, about 200 nM to about 300 nM, about 300 nM to about 400 nM, or about 400 nM to about 500 nM.

Chimeric or Humanized Antibodies

In some embodiments, the anti-CTLA-4 sdAb moiety provided herein is a chimeric antibody. Certain chimeric antibodies are described, e.g., in U.S. Pat. No. 4,816,567; and Morrison et al., Proc. Natl. Acad. Sci. USA, 81:6851-6855 (1984)). In one example, a chimeric antibody comprises a non-human variable region (e.g., a variable region derived from a camelid species, such as llama) and a human constant region. In a further example, a chimeric antibody is a "class switched" antibody in which the class or subclass has been changed from that of the parent antibody. Chimeric antibodies include antigen-binding fragments thereof.

In some embodiments, a chimeric antibody is a humanized antibody. Typically, a non-human antibody is humanized to reduce immunogenicity to humans, while retaining the specificity and affinity of the parental non-human antibody. Generally, a humanized antibody comprises one or more variable domains in which HVRs, e.g., CDRs, (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the HVR residues are derived), e.g., to restore or improve antibody specificity or affinity.

Humanized antibodies and methods of making them are reviewed, e.g., in Almagro and Fransson, Front. Biosci. 13:1619-1633 (2008), and are further described, e.g., in Riechmann et al., Nature 332:323-329 (1988); Queen et al., Proc. Nat'l Acad. Sci. USA 86:10029-10033 (1989); U.S. Pat. Nos. 5,821,337, 7,527,791, 6,982,321, and 7,087,409; Kashmiri et al., Methods 36:25-34 (2005) (describing SDR (a-CDR) grafting); Padlan, Mol. Immunol. 28:489-498 (1991) (describing "resurfacing"); Dall'Acqua et al., Methods 36:43-60 (2005) (describing "FR shuffling"); and Osbourn et al., Methods 36:61-68 (2005) and Klimka et al., Br. J. Cancer, 83:252-260 (2000) (describing the "guided selection" approach to FR shuffling).

Human framework regions that may be used for humanization include but are not limited to: framework regions selected using the "best-fit" method (see, e.g., Sims et al. J. Immunol. 151:2296 (1993)); framework regions derived from the consensus sequence of human antibodies of a particular subgroup of light or heavy chain variable regions (see, e.g., Carter et al. Proc. Natl. Acad. Sci. USA, 89:4285 (1992); and Presta et al. J. Immunol., 151:2623 (1993)); human mature (somatically mutated) framework regions or human germline framework regions (see, e.g., Almagro and Fransson, Front. Biosci. 13:1619-1633 (2008)); and framework regions derived from screening FR libraries (see, e.g., Baca et al., J. Biol. Chem. 272:10678-10684 (1997) and Rosok et al., J. Biol. Chem. 271:22611-22618 (1996)).

In some embodiments, the sdAbs are modified, such as humanized, without diminishing the native affinity of the domain for antigen and while reducing its immunogenicity with respect to a heterologous species. For example, the amino acid residues of the antibody variable domain (V$_H$H) of an llama antibody can be determined, and one or more of the Camelid amino acids, for example, in the framework regions, are replaced by their human counterpart as found in the human consensus sequence, without that polypeptide losing its typical character, i.e. the humanization does not significantly affect the antigen binding capacity of the resulting polypeptide. Humanization of Camelid single-domain antibodies requires the introduction and mutagenesis of a limited amount of amino acids in a single polypeptide chain. This is in contrast to humanization of scFv, Fab', (Fab')2 and IgG, which requires the introduction of amino acid changes in two chains, the light and the heavy chain and the preservation of the assembly of both chains.

Single-domain antibodies comprising a V$_H$H domain can be humanized to have human-like sequences. In some embodiments, the FR regions of the V$_H$H domain used herein comprise at least about any one of 50%, 60%, 70%, 80%, 90%, 95% or more of amino acid sequence homology to human VH framework regions. One exemplary class of humanized V$_H$H domains is characterized in that the V$_H$Hs carry an amino acid from the group consisting of glycine, alanine, valine, leucine, isoleucine, proline, phenylalanine, tyrosine, tryptophan, methionine, serine, threonine, asparagine, or glutamine at position 45, such as, for example, L45 and a tryptophan at position 103, according to the Kabat numbering. As such, polypeptides belonging to this class show a high amino acid sequence homology to human VH framework regions and said polypeptides might be administered to a human directly without expectation of an unwanted immune response therefrom, and without the burden of further humanization.

Another exemplary class of humanized Camelid single-domain antibodies has been described in WO 03/035694 and contains hydrophobic FR2 residues typically found in conventional antibodies of human origin or from other species, but compensating this loss in hydrophilicity by the charged arginine residue on position 103 that substitutes the conserved tryptophan residue present in V$_H$ from double-chain antibodies. As such, peptides belonging to these two classes show a high amino acid sequence homology to human V$_H$ framework regions and said peptides might be administered to a human directly without expectation of an unwanted immune response therefrom, and without the burden of further humanization.

Human Antibodies

In some embodiments, the anti-CTLA-4 sdAb moiety provided herein is a human antibody. Human antibodies can be produced using various techniques known in the art. Human antibodies are described generally in van Dijk and van de Winkel, Curr. Opin. Pharmacol. 5: 368-74 (2001) and Lonberg, Curr. Opin. Immunol. 20:450-459 (2008). Transgenic mice or rats capable of producing fully human single-domain antibodies are known in the art. See, e.g., US20090307787A1, U.S. Pat. No. 8,754,287, US20150289489A1, US20100122358A1, and WO2004049794.

Human antibodies may be prepared by administering an immunogen to a transgenic animal that has been modified to produce intact human antibodies or intact antibodies with human variable regions in response to antigenic challenge.

Such animals typically contain all or a portion of the human immunoglobulin loci, which replace the endogenous immunoglobulin loci, or which are present extrachromosomally or integrated randomly into the animal's chromosomes. In such transgenic mice, the endogenous immunoglobulin loci have generally been inactivated. For review of methods for obtaining human antibodies from transgenic animals, see Lonberg, *Nat. Biotech.* 23:1117-1125 (2005). See also, e.g., U.S. Pat. Nos. 6,075,181 and 6,150,584 describing XENOMOUSE™ technology; U.S. Pat. No. 5,770,429 describing HuMab® technology; U.S. Pat. No. 7,041,870 describing K-M MOUSE® technology, and U.S. Patent Application Publication No. US 2007/0061900, describing VELOCIMOUSE® technology). Human variable regions from intact antibodies generated by such animals may be further modified, e.g., by combining with a different human constant region.

Human antibodies can also be made by hybridoma-based methods. Human myeloma and mouse-human heteromyeloma cell lines for the production of human monoclonal antibodies have been described. (See, e.g., Kozbor *J. Immunol.*, 133: 3001 (1984); Brodeur et al., *Monoclonal Antibody Production Techniques and Applications*, pp. 51-63 (Marcel Dekker, Inc., New York, 1987); and Boerner et al., *J. Immunol.*, 147: 86 (1991).) Human antibodies generated via human B-cell hybridoma technology are also described in Li et al., *Proc. Natl. Acad. Sci. USA,* 103:3557-3562 (2006). Additional methods include those described, for example, in U.S. Pat. No. 7,189,826 (describing production of monoclonal human IgM antibodies from hybridoma cell lines) and Ni, *Xiandai Mianyixue,* 26(4):265-268 (2006) (describing human-human hybridomas). Human hybridoma technology (Trioma technology) is also described in Vollmers and Brandlein, *Histology and Histopathology,* 20(3):927-937 (2005) and Vollmers and Brandlein, *Methods and Findings in Experimental and Clinical Pharmacology,* 27(3): 185-91 (2005).

Human antibodies may also be generated by isolating Fv clone variable domain sequences selected from human-derived phage display libraries. Such variable domain sequences may then be combined with a desired human constant domain. Techniques for selecting human antibodies from antibody libraries are described below.

One technique for obtaining $V_HH$ sequences directed against a particular antigen or target involves suitably immunizing a transgenic mammal that is capable of expressing heavy chain antibodies (i.e. so as to raise an immune response and/or heavy chain antibodies directed against said antigen or target), obtaining a suitable biological sample from said transgenic mammal that contains (nucleic acid sequences encoding) said $V_HH$ sequences (such as a blood sample, serum sample or sample of B-cells), and then generating $V_HH$ sequences directed against said antigen or target, starting from said sample, using any suitable technique known per se (such as any of the methods described herein or a hybridoma technique). For example, for this purpose, the heavy chain antibody-expressing mice and the further methods and techniques described in WO 02/085945, WO 04/049794 and WO 06/008548 and Janssens et al., Proc. Natl. Acad. Sci. USA. 2006 Oct. 10; 103(41):15130-5 can be used. For example, such heavy chain antibody expressing mice can express heavy chain antibodies with any suitable (single) variable domain, such as (single) variable domains from natural sources (e.g. human (single) variable domains, Camelid (single) variable domains or shark (single) variable domains), as well as for example synthetic or semi-synthetic (single) variable domains.

Library-Derived Antibodies

Antibodies of the present application may be isolated by screening combinatorial libraries for antibodies with the desired activity or activities. For example, a variety of methods are known in the art for generating phage display libraries and screening such libraries for antibodies possessing the desired binding characteristics. Such methods are reviewed, e.g., in Hoogenboom et al. in *Methods in Molecular Biology* 178:1-37 (O'Brien et al., ed., Human Press, Totowa, N.J., 2001) and further described, e.g., in the McCafferty et al., *Nature* 348:552-554; Clackson et al., *Nature* 352: 624-628 (1991); Marks et al., *J. Mol. Biol.* 222: 581-597 (1992); Marks and Bradbury, in *Methods in Molecular Biology* 248:161-175 (Lo, ed., Human Press, Totowa, N.J., 2003); Sidhu et al., *J. Mol. Biol.* 338(2): 299-310 (2004); Lee et al., *J. Mol. Biol.* 340(5): 1073-1093 (2004); Fellouse, *Proc. Natl. Acad. Sci. USA* 101(34): 12467-12472 (2004); and Lee et al., *J. Immunol. Methods* 284(1-2): 119-132(2004). Methods for constructing single-domain antibody libraries have been described, for example, see U.S. Pat. No. 7,371,849.

In certain phage display methods, repertoires of VH and VL genes are separately cloned by polymerase chain reaction (PCR) and recombined randomly in phage libraries, which can then be screened for antigen-binding phage as described in Winter et al., *Ann. Rev. Immunol.*, 12: 433-455 (1994). Repertoires of $V_HH$ genes can be similarly cloned by PCR, recombined randomly in phage libraries, and screened for antigen-binding phage. Phage typically display antibody fragments, either as single-chain Fv (scFv) fragments or as Fab fragments. Libraries from immunized sources provide high-affinity antibodies to the immunogen without the requirement of constructing hybridomas. Alternatively, the naive repertoire can be cloned (e.g., from human) to provide a single source of antibodies to a wide range of non-self and also self-antigens without any immunization as described by Griffiths et al., *EMBO J,* 12: 725-734 (1993). Finally, naive libraries can also be made synthetically by cloning unrearranged V-gene segments from stem cells, and using PCR primers containing random sequence to encode the highly variable CDR3 regions and to accomplish rearrangement in vitro, as described by Hoogenboom and Winter, *J. Mol. Biol.*, 227: 381-388 (1992). Patent publications describing human antibody phage libraries include, for example: U.S. Pat. No. 5,750,373, and US Patent Publication Nos. 2005/0079574, 2005/0119455, 2005/0266000, 2007/0117126, 2007/0160598, 2007/0237764, 2007/0292936, and 2009/0002360.

Antibodies or antibody fragments isolated from human antibody libraries are considered human antibodies or human antibody fragments herein.

Biological Activities

The biological activity of anti-CTLA-4 sdAb moiety described herein can be determined by measuring its half maximal inhibitory concentration ($IC_{50}$), which is a measure of the effectiveness of an antibody in inhibiting a specific biological or biochemical function (such as inhibiting the binding between CTLA-4 and its ligand B7-1 and/or B7-2). For example, here $IC_{50}$ can be used to indicate the effective concentration of anti-CTLA-4 sdAb needed to neutralize 50% of CTLA-4 bioactivity in vitro. $IC_{50}$ is comparable to an $EC_{50}$ for agonist drug or other substance (such as an antibody). $EC_{50}$ also represents the plasma concentration required for obtaining 50% of a maximum effect in vivo.

IC$_{50}$ or EC$_{50}$ can be measured by assays known in the art, for example, bioassays such as inhibition of ligand binding by FACS analysis (competition binding assay), cell based cytokine release assay, or amplified luminescent proximity homogeneous assay (AlphaLISA).

For example, the blockade of ligand binding can be studied using flow cytometry (also see Example 1). CHO cells expressing human B7-1 can be dissociated from adherent culture flasks and mixed with varying concentrations of anti-CTLA-4 sdAb for test, and a constant concentration of labeled-CTLA-4 protein (such as biotin-labeled hCTLA-4/Fc protein). An anti-CTLA-4 antibody positive control can be employed, such as Yervoy®. The mixture is equilibrated for 30 minutes at room temperature, washed three times with FACS buffer (PBS containing 1% BSA). Then, an antibody specifically recognizing the labeled CTLA-4 protein of constant concentration (such as PE/Cy5 Streptavidin secondary antibody) is added and incubated for 15 minutes at room temperature. Cells are washed with FACS buffer and analyzed by flow cytometry. Data can be analyzed with Prism (GraphPad Software, San Diego, Calif.) using non-linear regression to calculate IC$_{50}$. The results from the competition assay can demonstrate the ability of anti-CTLA-4 sdAbs in inhibiting the interaction between labeled-CTLA4 and B7-1.

The biological activity of anti-CTLA-4 sdAb moiety can also be tested by CTLA-4-based blockade assay for cytokine release (also see Example 1). CTLA-4 signaling does not regulate cell survival or responsiveness to IL-2, but inhibits CD28-dependent IL-2 production (Walunas et al., *J Exp Med* 183:2541-50 (1996)). Experimental allergic encephalomyelitis (EAE) is an autoimmune disorder induced by Th1 cells against myelin antigens, which provides an in vivo model for studying the role of B7-mediated co-stimulation in the induction of a pathological immune response. It was found that anti-CTLA-4 antibodies exacerbated EAE disease condition, with enhanced production of the encephalitogenic cytokines TNF-α, IFN-γ and IL-2 (Perrin et al., *J Immunol* 157:1333-6 (1996)). Thus, blockade of CTLA-4 pathways by anti-CTLA-4 antibodies can be studied using a variety of bioassays that monitor T cell proliferation, IFN-γ release, or IL-2 secretion.

For examples, CD4+ T cells (can be purified from PBMC by isolation kits) and CHO-K1/human CD80 (CHO-K1 stably expressing human CD80) are mixed in wells. Test anti-CTLA-4 sdAbs are added into each well at different concentrations. No antibody can be used as a background control. Negative control (such as human IgG4) and positive control (such as Yervoy®) can be employed. A CTLA-4 protein is added into the system to initiate the reaction. After 24-hour incubation in 37° C./5% CO$_2$ incubator, medium is taken from each testing well for IL-2 secretion measurement (Cisbio). EC$_{50}$ value for each test antibody is measured, which will reflect the ability of test anti-CTLA-4 sdAb in blocking the interaction between CD80 and CTLA-4 on T cells, thus in inhibiting T-cell IL-2 production.

In some embodiments, the anti-CTLA-4 sdAb moiety blocks or antagonizes signals transduced by the CTLA-4 receptor. In some embodiments, the anti-CTLA-4 sdAb moiety can bind to an epitope on CTLA-4 so as to inhibit CTLA-4 from interacting with a B7 ligand (such as B7-1 and/or B7-2). In some embodiments, the anti-CTLA-4 sdAb moiety can reduce the binding of CTLA-4 to a B7 ligand (such as B7-1 and/or B7-2) by at least about any of 5%, 10%, 20%, 25%, 30%, 40%, 50%, 60%, 70%, 75%, 80%, 90%, 95%, 99% or 99.9% under conditions in which the ratio of antibody combining site to CTLA-4 ligand binding site is greater than 1:1 and the concentration of antibody is greater than 10$^{-8}$ M.

(II) Construct Comprising the Anti-CTLA-4 sdAb Moiety

The anti-CTLA-4 construct comprising the anti-CTLA-4 sdAb moiety can be of any possible format.

In some embodiments, the anti-CTLA-4 construct comprising the anti-CTLA-4 sdAb moiety may further comprise additional polypeptide sequences, such as one or more antibody moieties, or Fc fragment of immunoglobulin. Such additional polypeptide sequences may or may not change or otherwise influence the (biological) properties of the sdAb, and may or may not add further functionality to the sdAb described herein. In some embodiments, the additional polypeptide sequences confer one or more desired properties or functionalities to the sdAb of the present invention. In some embodiments, the anti-CTLA-4 construct is a chimeric antigen receptor (CAR) comprising an extracellular antigen binding domain comprising one or more anti-CTLA-4 sdAb moiety described herein.

In some embodiments, the additional polypeptide sequences may be a second antibody moiety (such as sdAb, scFv, Fab, full-length antibody) that specifically recognizes a second antigen or a second epitope. In some embodiments, the second antigen is not CTLA-4. In some embodiments, the second epitope is from CTLA-4. In some embodiments, the second epitope is not from CTLA-4. In some embodiments, the second antibody moiety specifically recognizes the same epitope on CTLA-4 as the anti-CTLA-4 sdAb described herein. In some embodiments, the second antibody moiety specifically recognizes a different epitope on CTLA-4 as the anti-CTLA-4 sdAb described herein.

In some embodiments, the additional polypeptide sequences may increase the antibody construct half-life, solubility, or absorption, reduce immunogenicity or toxicity, eliminate or attenuate undesirable side effects, and/or confer other advantageous properties to and/or reduce undesired properties of the anti-CTLA-4 construct of the invention, compared to the anti-CTLA-4 sdAb described herein per se. Some non-limiting examples of such additional polypeptide sequences are serum proteins, such as human serum albumin (see for example WO 00/27435) or haptenic molecules (for example haptens that are recognized by circulating antibodies, see for example WO 98/22141). It was shown that linking fragments of immunoglobulins (such as V$_H$ domains) to serum albumin or fragments thereof may increase antibody half-life (see e.g. WO 00/27435 and WO 01/077137). Thus, in some embodiments, the anti-CTLA-4 construct of the present invention may comprise an anti-CTLA-4 sdAb moiety described herein linked to serum albumin (or to a suitable fragment thereof), optionally via a suitable linker (such as peptide linker). In some embodiments, the anti-CTLA-4 sdAb moiety described herein can be linked to a fragment of serum albumin at least comprising serum albumin domain III. (see PCT/EP2007/002817).

Heavy Chain-Only Antibody (HCAb)

In some embodiments, anti-CTLA-4 sdAb moiety described herein can be linked to one or more (preferably human) C$_H$2 and/or C$_H$3 domains, e.g., an Fc fragment, optionally via a linker sequence, to increase its half-life in vivo.

Thus in some embodiments, the anti-CTLA-4 construct is an HCAb (hereinafter referred to as "anti-CTLA-4 HCAb") comprising an anti-CTLA-4 sdAb moiety described herein fused to an Fc fragment of an immunoglobulin, such as IgA, IgD, IgE, IgG, and IgM. In some embodiments, the anti-CTLA-4 HCAb comprises an Fc sequence of IgG, such as any of IgG1, IgG2, IgG3, or IgG4. In some embodiments, the Fc fragment is a human Fc. In some embodiments, the Fc fragment is a human IgG1 Fc. In some embodiments, the anti-CTLA-4 HCAb is monomeric. In some embodiments, the anti-CTLA-4 HCAb is dimeric. In some embodiments, the anti-CTLA-4 sdAb moiety and the Fc fragment are optionally connected by a peptide linker. In some embodiments, the peptide linker is a human IgG1 hinge (SEQ ID NO: 163). In some embodiments, the peptide linker is a mutated human IgG1 hinge (SEQ ID NO: 307). In some embodiments, the peptide linker comprises the amino acid sequence of SEQ ID NO: 162 (GGGGSGGGS) or SEQ ID NO: 365 (GGGGSGGGGSGGGGS).

Thus in some embodiments, there is provided an anti-CTLA-4 HCAb comprising a sdAb moiety specifically recognizing CTLA-4, wherein the sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and wherein the sdAb moiety is fused to an Fc fragment of an immunoglobulin. In some embodiments, there is provided an anti-CTLA-4 HCAb comprising a sdAb moiety specifically recognizing CTLA-4, wherein the sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions, and wherein the sdAb moiety is fused to an Fc fragment of an immunoglobulin. In some embodiments, the amino acid substitutions are in CDR1 and/or CDR2. In some embodiments, there is provided an anti-CTLA-4 HCAb comprising a sdAb moiety specifically recognizing CTLA-4, wherein the sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262, and wherein the sdAb moiety is fused to an Fc fragment of an immunoglobulin. In some embodiments, the anti-CTLA-4 sdAb moiety comprises a $V_HH$ domain comprising the amino acid sequence of any one of the following: a-1) the amino acid residue at position 37 is selected from the group consisting of F, Y, V, L, A, H, S, I, W, C, N, G, D, T, and P (such as F, Y, L, I, or V, or such as F or Y, or such as F); a-2) the amino acid residue at position 44 is selected from the group consisting of E, Q, G, D, A, K, R, L, P, S, V, H, T, N, W, M, and I (such as A, G, E, D, Q, R, S, or L, or such as G, E, or Q); a-3) the amino acid residue at position 45 is selected from the group consisting of L, R, P, H, F, G, Q, S, E, T, Y, C, I, D, and V (such as L, C, or R, or such as L or R); a-4) the amino acid residue at position 103 is selected from the group consisting of W, R, G, S, K, A, M, Y, I, F, T, N, V, Q, P, E, and C (such as W, G, or R, or such as W); and a-5) the amino acid residue at position 108 is selected from the group consisting of Q, L, R, P, E, K, S, T, M, A, and H (such as Q); or b-1) the amino acid residue at position 37 is selected from the group consisting of F, Y, L, I, and V (such as F or Y, or such as F); b-2) the amino acid residue at position 44 is selected from the group consisting of E and Q; b-3) the amino acid residue at position 45 is selected from the group consisting of L and R (such as R); b-4) the amino acid residue at position 103 is selected from the group consisting of G, W, R and S (such as W); and b-5) the amino acid residue at position 108 is selected from the group consisting of Q and L (such as Q); or c-1) the amino acid residue at position 37 is selected from the group consisting of F, Y, L, I, and V (such as F or Y, or such as F); c-2) the amino acid residue at position 44 is selected from the group consisting of A, G, E, D, Q, R, S and L (such as G, E, or Q); c-3) the amino acid residue at position 45 is selected from the group consisting of L, R and C (such as L or R); c-4) the amino acid residue at position 103 is selected from the group consisting of P, R and S (such as R or S); and c-5) the amino acid residue at position 108 is selected from the group consisting of Q and L (such as Q); wherein the amino acid position is according to Kabat numbering, and wherein position 108 can be optionally humanized to L when position 108 is Q. In some embodiments, the Fc fragment is a human IgG1 Fc. In some embodiments, the anti-CTLA-4 HCAb is monomeric. In some embodiments, the anti-CTLA-4 HCAb is dimeric. In some embodiments, the anti-CTLA-4 sdAb moiety and the Fc fragment are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 HCAb comprising an sdAb moiety specifically recognizing CTLA-4, wherein the sdAb moiety comprises a $V_HH$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353. In some embodiments, there is provided an anti-CTLA-4 HCAb comprising a sdAb moiety specifically recognizing CTLA-4, wherein the sdAb moiety comprises a $V_HH$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_HH$ domain. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in CDRs, such as the CDR1, and/or the CDR2, and/or the CDR3 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises CDR1, CDR2, and CDR3 of any one of SEQ ID NOs: 113-129, 200-202, 274-282, 341-344, 352, and 353, and the amino acid substitutions are in FRs, such as the FR1, and/or the FR2, and/or the FR3, and/or the FR4 of any one of SEQ ID NOs:

113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in both CDRs and FRs. In some embodiments, there is provided an anti-CTLA-4 HCAb comprising an sdAb moiety specifically recognizing CTLA-4, wherein the sdAb moiety comprises a $V_HH$ domain comprising the amino acid sequence of any one of SEQ ID NOs: 113-129, 200-202, 274-282, 341-344, 352, and 353. In some embodiments, there is provided an anti-CTLA-4 HCAb comprising a sdAb moiety specifically recognizing CTLA-4, wherein the sdAb moiety comprises CDR1, CDR2, and CDR3 of any one of SEQ ID NOs: 113-129, 200-202, 274-282, 341-344, 352, and 353. In some embodiments, the Fc fragment is a human IgG1 Fc. In some embodiments, the anti-CTLA-4 HCAb is monomeric. In some embodiments, the anti-CTLA-4 HCAb is dimeric. In some embodiments, the anti-CTLA-4 sdAb moiety and the Fc fragment are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 HCAb comprising the amino acid sequence of any one of SEQ ID NOs: 130-133, 283-291, and 366-371.

In some embodiments, there is also provided an anti-CTLA-4 HCAb (hereinafter referred to as "competing anti-CTLA-4 HCAb") that specifically binds to CTLA-4 competitively with any one of the anti-CTLA-4 HCAbs, anti-CTLA-4 sdAbs, or anti-CTLA-4 constructs comprising the anti-CTLA-4 sdAb moiety described herein. Competitive binding may be determined using an ELISA assay. For example, in some embodiments, there is provided an anti-CTLA-4 HCAb that specifically binds to CTLA-4 competitively with an anti-CTLA-4 HCAb comprising the amino acid sequence of any one of SEQ ID NOs: 130-133, 283-291, and 366-371. For another example, in some embodiments, there is provided an anti-CTLA-4 HCAb that specifically binds to CTLA-4 competitively with an anti-CTLA-4 HCAb comprising a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, there is provided an anti-CTLA-4 HCAb that specifically binds to CTLA-4 competitively with an anti-CTLA-4 sdAb (or an anti-CTLA-4 construct comprising an anti-CTLA-4 sdAb) comprising a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the $K_d$ of the binding between the competing anti-CTLA-4 HCAb and CTLA-4 is about $10^{-5}$ M to about $10^{-12}$M (such as about $10^{-7}$ M to about $10^{-12}$ M, or about $10^{-8}$ M to about $10^{-12}$ M). In some embodiments, the competing anti-CTLA-4 HCAb is camelid, chimeric, human, partially humanized, or fully humanized.

Multivalent and/or Multispecific Antibodies

In some embodiments, the anti-CTLA-4 construct comprises an anti-CTLA-4 sdAb moiety described herein fused to one or more other antibody moiety (such as an antibody moiety that specifically recognizes another antigen or another epitope). The one or more other antibody moiety can be of any antibody or antibody fragment format, such as a multispecific sdAb (such as bispecific sdAb), a full-length antibody, a Fab, a Fab', a (Fab')2, an Fv, a single chain Fv (scFv), an scFv-scFv, a minibody, a diabody, or an sdAb. In some embodiments, the one or more antibody moiety comprises a heavy chain variable domain ($V_H$) and a light chain variable domain ($V_L$). For a review of certain antibody fragments, see Hudson et al. Nat. Med. 9:129-134 (2003). For a review of scFv fragments, see, e.g., Pluckthün, in The Pharmacology of Monoclonal Antibodies, vol. 113, Rosenburg and Moore eds., (Springer-Verlag, New York), pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869,046. For a review of multispecific antibodies, see Weidle et al., Cancer Genomics Proteomics, 10(1):1-18, 2013; Geering and Fussenegger, Trends Biotechnol., 33(2): 65-79, 2015; Stamova et al., Antibodies, 1(2):172-198, 2012. Diabodies are antibody fragments with two antigen-binding sites that may be bivalent or bispecific. See, for example, EP 404,097; WO 1993/01161; Hudson et al., Nat. Med. 9:129-134 (2003); and Hollinger et al., Proc. Natl. Acad. Sci. USA 90: 6444-6448 (1993). Triabodies and tetrabodies are also described in Hudson et al., Nat. Med. 9:129-134 (2003). Antibody fragments can be made by various techniques, including but not limited to proteolytic digestion of an intact antibody as well as production by recombinant host cells (e.g. E. coli or phage), as described herein.

Techniques for making multispecific antibodies include, but are not limited to, recombinant co-expression of two immunoglobulin heavy chain-light chain pairs having different specificities (see Milstein and Cuello, Nature 305: 537 (1983)), WO 93/08829, and Traunecker et al., EMBO J. 10: 3655 (1991)), and "knob-in-hole" engineering (see, e.g., U.S. Pat. No. 5,731,168). Multi-specific antibodies may also be made by engineering electrostatic steering effects for making antibody Fc-heterodimeric molecules (WO 2009/089004A1); cross-linking two or more antibodies or fragments (see, e.g., U.S. Pat. No. 4,676,980, and Brennan et al., Science, 229: 81 (1985)); using leucine zippers to produce bi-specific antibodies (see, e.g., Kostelny et al., J. Immunol., 148(5):1547-1553 (1992)); using "diabody" technology for making bispecific antibody fragments (see, e.g., Hollinger et al., Proc. Natl. Acad. Sci. USA, 90:6444-6448 (1993)); and using single-chain Fv (sFv) dimers (see, e.g., Gruber et al., J. Immunol., 152:5368 (1994)); and preparing trispecific antibodies as described, e.g., in Tutt et al. J. Immunol. 147: 60 (1991); and creating polypeptides comprising tandem single-domain antibodies (see, e.g., U.S. Patent Application No. 20110028695; and Conrath et al. J. Biol. Chem., 2001; 276(10):7346-50). Engineered antibodies with three or more functional antigen binding sites, including "Octopus antibodies," are also included herein (see, e.g., US 2006/0025576A1).

Peptide Linkers

In some embodiments, the two or more antibody moieties (such as anti-CTLA-4 sdAb, a full-length antibody, or an antigen binding portion comprising a $V_H$ and a $V_L$) within the anti-CTLA-4 construct can be optionally connected by a peptide linker. The length, the degree of flexibility and/or other properties of the peptide linker(s) used in the anti-CTLA-4 construct may have some influence on properties, including but not limited to the affinity, specificity or avidity for one or more particular antigens or epitopes. For example, longer peptide linkers may be selected to ensure that two adjacent domains do not sterically interfere with one another. In some embodiment, a peptide linker comprises flexible residues (such as glycine and serine) so that the adjacent domains are free to move relative to each other. For example, a glycine-serine doublet can be a suitable peptide linker.

The peptide linker can be of any suitable length. In some embodiments, the peptide linker is at least about any of 1, 2, 3, 4, 5, 6, 7, 8, 9, 10, 11, 12, 13, 14, 15, 16, 17, 18, 19, 20, 25, 30, 35, 40, 50, 75, 100 or more amino acids long. In some embodiments, the peptide linker is no more than about any of 100, 75, 50, 40, 35, 30, 25, 20, 19, 18, 17, 16, 15, 14, 13, 12, 11, 10, 9, 8, 7, 6, 5 or fewer amino acids long. In some embodiments, the length of the peptide linker is any of about 1 amino acid to about 10 amino acids, about 1 amino acids to about 20 amino acids, about 1 amino acid to about 30 amino acids, about 5 amino acids to about 15 amino acids, about 10 amino acids to about 25 amino acids, about 5 amino acids to about 30 amino acids, about 10 amino acids to about 30 amino acids long, about 30 amino acids to about 50 amino acids, about 50 amino acids to about 100 amino acids, or about 1 amino acid to about 100 amino acids.

The peptide linker may have a naturally occurring sequence, or a non-naturally occurring sequence. For example, a sequence derived from the hinge region of heavy chain only antibodies may be used as the linker. See, for example, WO1996/34103. In some embodiments, the peptide linker is a human IgG1 hinge (SEQ ID NO: 163). In some embodiments, the peptide linker is a mutated human IgG1 hinge (SEQ ID NO: 307). In some embodiments, the peptide linker is a flexible linker. Exemplary flexible linkers include glycine polymers $(G)_n$ (SEQ ID NO: 375), glycine-serine polymers (including, for example, $(GS)_n$ (SEQ ID NO: 376), $(GSGGS)_n$ (SEQ ID NO: 377), $(GGGS)_n$ (SEQ ID NO: 378), and $(GGGGS)_n$ (SEQ ID NO: 379), where n is an integer of at least one), glycine-alanine polymers, alanine-serine polymers, and other flexible linkers known in the art. In some embodiments, the peptide linker comprises the amino acid sequence of GGGGSGGGS (SEQ ID NO: 162). In some embodiments, the peptide linker comprises the amino acid sequence SEQ ID NO: 365 (GGGGSGGGGSGGGGS).

In some embodiments, the anti-CTLA-4 construct comprising an anti-CTLA-4 sdAb moiety and one or more other antibody moiety (such as a full-length antibody, or an antigen binding portion comprising a $V_H$ and a $V_L$) is monospecific. In some embodiments, the anti-CTLA-4 construct comprising an anti-CTLA-4 sdAb moiety and one or more other antibody moiety (such as a full-length antibody, or an antigen binding portion comprising a $V_H$ and a $V_L$) is multispecific (such as bispecific). Multispecific molecules are molecules that have binding specificities for at least two different antigens or epitopes (e.g., bispecific antibodies have binding specificities for two antigens or epitopes). Multispecific molecules with more than two valencies and/or specificities are also contemplated. For example, trispecific antibodies can be prepared. Tutt et al. *J. Immunol.* 147: 60 (1991). It is to be appreciated that one of skill in the art could select appropriate features of individual multispecific molecules described herein to combine with one another to form a multi-specific anti-CTLA-4 molecule of the invention.

In some embodiments, the anti-CTLA-4 construct is multivalent but monospecific, i.e., the anti-CTLA-4 construct comprises an anti-CTLA-4 sdAb moiety described herein and at least a second antibody moiety (such as a full-length antibody, or an antigen binding portion comprising a $V_H$ and a $V_L$) specifically recognizing the same CTLA-4 epitope as the anti-CTLA-4 sdAb moiety. In some embodiments, the one or more antibody moiety specifically recognizing the same CTLA-4 epitope as the anti-CTLA-4 sdAb moiety described herein may comprise the same CDRs and/or the same $V_H H$ amino acid sequence as the anti-CTLA-4 sdAb moiety. For example, the anti-CTLA-4 construct may comprise two or more anti-CTLA-4 sdAb moieties described herein, wherein the two or more anti-CTLA-4 sdAb moieties are the same. In some embodiments, the anti-CTLA-4 sdAb moieties are optionally connected by peptide linker(s). In some embodiments, the peptide linker comprises the amino acid sequence of SEQ ID NO: 162, 163, 307, or 365.

In some embodiments, the anti-CTLA-4 construct is multivalent and multispecific, i.e., the anti-CTLA-4 construct comprises an anti-CTLA-4 sdAb moiety described herein and at least a second antibody moiety (such as a full-length antibody, or an antigen binding portion comprising a $V_H$ and a $V_L$) specifically recognizing a second antigen other than CTLA-4, or a different CTLA-4 epitope recognized by the anti-CTLA-4 sdAb moiety described herein. In some embodiments, the second antibody moiety is an sdAb. In some embodiments, the second antibody moiety specifically recognizes human serum albumin (HSA). In some embodiments, the sdAb moiety specifically recognizing CTLA-4 is fused to the N-terminus and/or C-terminus of the second antibody moiety. In some embodiments, the anti-CTLA-4 construct is trivalent and bispecific. In some embodiments, the anti-CTLA-4 construct comprises two anti-CTLA-4 sdAbs described herein and a second antibody moiety (such as an anti-HSA sdAb), wherein the second antibody moiety is in between the two anti-CTLA-4 sdAbs. In some embodiments, the antibody moieties are optionally connected by peptide linker(s). In some embodiments, the peptide linker comprises the amino acid sequence of SEQ ID NO: 162, 163, 307, or 365.

The monospecific or multispecific anti-CTLA-4 construct comprising two or more sdAb moieties specifically recognizing CTLA-4 may have increase avidity compared to that of a single anti-CTLA-4 sdAb moiety described here.

Bispecific Antibodies Comprising sdAb Fused to Full-Length Antibody

In some embodiments, the anti-CTLA-4 construct comprises an anti-CTLA-4 sdAb moiety described herein fused to a second antibody moiety, wherein the second antibody moiety is a full-length antibody consisting of two heavy chains and two light chains (such as anti-PD-1 or anti-PD-L1 full-length antibody). The construct comprising bi-specificity against CTLA-4 and PD-1 will be hereinafter referred to as "anti-CTLA-4/PD-1 antibody", "anti-CTLA-4/PD-1 construct", or "CTLA-4×PD-1 antibody". The construct comprising bi-specificity against CTLA-4 and PD-L1 will be hereinafter referred to as "anti-CTLA-4/PD-L1 antibody", "anti-CTLA-4/PD-L1 construct", or "CTLA-4×PD-L1 antibody".

PD-1 and PD-L1, similar to CTLA-4, are inhibitory immune checkpoint molecules.

PD-1 is a part of the B7/CD28 family of co-stimulatory molecules that regulate T-cell activation and tolerance, and thus antagonistic anti-PD-1 antibodies can be useful for overcoming tolerance. PD-1 has been defined as a receptor for B7-4. B7-4 can inhibit immune cell activation upon binding to an inhibitory receptor on an immune cell. Engagement of the PD-1/PD-L1 pathway results in inhibition of T-cell effector function, cytokine secretion and proliferation. (Turnis et al., OncoImmunology 1(7):1172-1174, 2012). High levels of PD-1 are associated with exhausted or chronically stimulated T cells. Moreover, increased PD-1 expression correlates with reduced survival in cancer patients. Agents for down modulating PD-1, B7-4, and the interaction between B7-4 and PD-1 inhibitory signal in an immune cell can result in enhancement of the immune response. Exemplary anti-PD-1 antibodies that can be applied in the present application include, but are not limited to, pembrolizumab (e.g., Keytruda®) and nivolumab (e.g., Opdivo®).

PD-L1 (Programmed cell death-ligand 1) is also known as cluster of differentiation 274 (CD274) or B7 homolog 1 (B7-H1). PD-L1 serves as a ligand for PD-1 to play a major role in suppressing the immune system during particular events such as pregnancy, tissue allographs, autoimmune disease and other disease states such as hepatitis and cancer. The formation of PD-1 receptor/PD-L1 ligand complex transmits an inhibitory signal which reduces the proliferation of CD8+ T cells at the lymph nodes. Exemplary anti-PD-L1 antibodies that can be applied in the present application include, but are not limited to, atezolizumab (e.g., Tecentriq®) and Durvalumab (e.g., MEDI4736, IMFINZI™).

In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized. In some embodiments, the anti-PD-1 full-length antibody comprises a heavy chain comprising the amino acid sequence of SEQ ID NO: 158, and a light chain comprising the amino acid sequence of SEQ ID NO: 159. In some embodiments, the anti-PD-1 full-length antibody comprises a heavy chain comprising the amino acid sequence of SEQ ID NO: 160, and a light chain comprising the amino acid sequence of SEQ ID NO: 161. In some embodiments, the anti-PD-1 full-length antibody comprises a heavy chain comprising the amino acid sequence of SEQ ID NO: 308, and a light chain comprising the amino acid sequence of SEQ ID NO: 309. In some embodiments, the full-length antibody comprises a heavy chain comprising the amino acid sequence of SEQ ID NO: 158, and a light chain comprising the amino acid sequence of SEQ ID NO: 159, wherein at least one of the heavy chains of the full-length antibody is fused to the anti-CTLA-4 sdAb, and wherein the heavy chain fusion polypeptide comprises the amino acid sequence of any one of SEQ ID NOs: 134-145, 292-296, and 319-323. In some embodiments, the full-length antibody comprises a heavy chain comprising the amino acid sequence of SEQ ID NO: 160, and a light chain comprising the amino acid sequence of SEQ ID NO: 161, wherein at least one of the heavy chains of the full-length antibody is fused to the anti-CTLA-4 sdAb, and wherein the heavy chain fusion polypeptide comprises the amino acid sequence of any one of SEQ ID NOs: 146-157, 297-301, and 324-328. In some embodiments, the full-length antibody comprises a heavy chain comprising the amino acid sequence of SEQ ID NO: 308, and a light chain comprising the amino acid sequence of SEQ ID NO: 309, wherein at least one of the heavy chains of the full-length antibody is fused to the anti-CTLA-4 sdAb, and wherein the heavy chain fusion polypeptide comprises the amino acid sequence of any one of SEQ ID NOs: 310-318 and 329-337. In some embodiments, the full-length antibody comprises a heavy chain comprising the amino acid sequence of SEQ ID NO: 158, and a light chain comprising the amino acid sequence of SEQ ID NO: 159, wherein at least one of the light chains of the full-length antibody is fused to the anti-CTLA-4 sdAb, and wherein the light chain fusion polypeptide comprises the amino acid sequence of SEQ ID NO: 354 or 355. In some embodiments, the anti-CTLA-4 construct comprises two copies of heavy chain fusion polypeptide comprising the amino acid sequence of SEQ ID NO: 356, and two copies of light chain fusion polypeptide comprising the amino acid sequence of SEQ ID NO: 357. In some embodiments, the anti-CTLA-4 construct comprises two copies of heavy chain fusion polypeptide comprising the amino acid sequence of SEQ ID NO: 358, and two copies of light chain comprising the amino acid sequence of SEQ ID NO: 159.

In some embodiments, there is provided an isolated anti-CTLA-4 construct comprising a sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353. In some embodiments, there is provided an isolated anti-CTLA-4 construct comprising a sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_HH$ domain. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in CDRs, such as the CDR1, and/or the CDR2, and/or the CDR3 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises CDR1, CDR2, and CDR3 of any one of SEQ ID NOs: 113-129, 200-202, 274-282, 341-344, 352, and 353, and the amino acid substitutions are in FRs, such as the FR1, and/or the FR2, and/or the FR3, and/or the FR4 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in both CDRs and FRs. In some embodiments, there is provided an isolated anti-CTLA-4 construct comprising an sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353. In some embodiments, there is provided an isolated anti-CTLA-4 construct comprising an sdAb moiety specifically recognizing CTLA-4 and an anti-PD-1 full-length antibody, wherein the sdAb moiety comprises CDR1, CDR2, and CDR3 of any one of SEQ ID NOs: 113-129, 200-202, 274-282, 341-344, 352, and 353. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the full-length antibody comprises a heavy chain comprising the amino acid sequence of SEQ ID NO: 158, and a light chain comprising the amino acid sequence of SEQ ID NO: 159. In some embodiments, the full-length antibody comprises a heavy chain comprising the amino acid sequence of SEQ ID NO: 160, and a light chain comprising the amino acid sequence of SEQ ID NO: 161. In some embodiments, the full-length antibody comprises a heavy chain comprising the amino acid sequence of SEQ ID NO: 308, and a light chain comprising the amino acid sequence of SEQ ID NO: 309. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and wherein the full-length antibody comprises a heavy chain comprising the amino acid sequence of SEQ ID NO: 158, and a light chain comprising the amino acid sequence of SEQ ID NO: 159. In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions, and wherein the full-length antibody comprises a heavy chain comprising the amino acid sequence of SEQ ID NO: 158, and a light chain comprising the amino acid sequence of SEQ ID NO: 159. In some embodiments, the amino acid substitutions are in CDR1 and/or CDR2. In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262, and wherein the full-length antibody comprises a heavy chain comprising the amino acid sequence of SEQ ID NO: 158, and a light chain comprising the amino acid sequence of SEQ ID NO: 159. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353, and wherein the full-length antibody comprises a heavy chain comprising the amino acid sequence of SEQ ID NO: 158, and a light chain comprising the amino acid sequence of SEQ ID NO: 159. In some embodiments, there is provided an isolated anti-CTLA-4 construct comprising a sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_HH$ domain, and wherein the full-length antibody comprises a heavy chain comprising the amino acid sequence of SEQ ID NO: 158, and a light chain comprising the amino acid sequence of SEQ ID NO: 159. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in CDRs, such as the CDR1, and/or the CDR2, and/or the CDR3 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises CDR1, CDR2, and CDR3 of any one of SEQ ID NOs: 113-129, 200-202, 274-282, 341-344, 352, and 353, and the amino acid substitutions are in FRs, such as the FR1, and/or the FR2, and/or the FR3, and/or the FR4 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in both CDRs and FRs. In some embodiments, there is provided an isolated anti-CTLA-4 construct comprising a sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353, and wherein the full-length antibody comprises a heavy chain comprising the amino acid sequence of SEQ ID NO: 158, and a light chain comprising the amino acid sequence of SEQ ID NO: 159. In some embodiments, there is provided an isolated anti-CTLA-4 construct comprising a sdAb moiety specifically recognizing CTLA-4 and an anti-PD-1 full-length antibody, wherein the sdAb moiety comprises CDR1, CDR2, and CDR3 of any one of SEQ ID NOs: 113-129, 200-202, 274-282, 341-344, 352, and 353, and wherein the full-length antibody comprises a heavy chain comprising the amino acid sequence of SEQ ID NO: 158, and a light chain comprising the amino acid sequence of SEQ ID NO: 159. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and wherein the full-length antibody comprises a heavy chain comprising the amino acid sequence of SEQ ID NO: 160, and a light chain comprising the amino acid sequence of SEQ ID NO: 161. In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions, and wherein the full-length antibody comprises a heavy chain comprising the amino acid sequence of SEQ ID NO: 160, and a light chain comprising the amino acid sequence of SEQ ID NO: 161. In some embodiments, the amino acid substitutions are in CDR1 and/or CDR2. In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262, and wherein the full-length antibody comprises a heavy chain comprising the amino acid sequence of SEQ ID NO: 160, and a light chain comprising the amino acid sequence of SEQ ID NO: 161. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353, and wherein the full-length antibody comprises a heavy chain comprising the amino acid sequence of SEQ ID NO: 160, and a light chain comprising the amino acid sequence of SEQ ID NO: 161. In some embodiments, there is provided an isolated anti-CTLA-4 construct comprising a sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_HH$ domain, and wherein the full-length antibody comprises a heavy chain comprising the amino acid sequence of SEQ ID NO: 160, and a light chain comprising the amino acid sequence of SEQ ID NO: 161. In some embodiments, the anti-CTLA-4 sdAb moiety comprising the V$_H$H domain comprising the amino acid sequence of any one of SEQ ID NOs: 113-129, 200-202, 274-282, 341-344, 352, and 353 or a variant thereof comprises amino acid substitutions in CDRs, such as the CDR1, and/or the CDR2, and/or the CDR3 of any one of SEQ ID NOs: 113-129, 200-202, 274-282, 341-344, 352, and 353. In some embodiments, the anti-CTLA-4 sdAb moiety comprising the V$_H$H domain comprising the amino acid sequence of any one of SEQ ID NOs: 113-129, 200-202, 274-282, 341-344, 352, and 353 or a variant thereof comprises CDR1, CDR2, and CDR3 of any one of SEQ ID NOs: 113-129, 200-202, 274-282, 341-344, 352, and 353, and the amino acid substitutions are in FRs, such as the FR1, and/or the FR2, and/or the FR3, and/or the FR4 of any one of SEQ ID NOs: 113-129, 200-202, 274-282, 341-344, 352, and 353. In some embodiments, the anti-CTLA-4 sdAb moiety comprising the V$_H$H domain comprising the amino acid sequence of any one of SEQ ID NOs: 113-129, 200-202, 274-282, 341-344, 352, and 353 or a variant thereof comprises amino acid substitutions in both CDRs and FRs. In some embodiments, there is provided an isolated anti-CTLA-4 construct comprising a sdAb moiety specifically recognizing CTLA-4 and an anti-PD-1 full-length antibody, wherein the sdAb comprises a V$_H$H domain comprising the amino acid sequence of any one of SEQ ID NOs: 113-129, 200-202, 274-282, 341-344, 352, and 353, and wherein the full-length antibody comprises a heavy chain comprising the amino acid sequence of SEQ ID NO: 160, and a light chain comprising the amino acid sequence of SEQ ID NO: 161. In some embodiments, there is provided an isolated anti-CTLA-4 construct comprising a sdAb moiety specifically recognizing CTLA-4 and an anti-PD-1 full-length antibody, wherein the sdAb moiety comprises CDR1, CDR2, and CDR3 of any one of SEQ ID NOs: 113-129, 200-202, 274-282, 341-344, 352, and 353, and wherein the full-length antibody comprises a heavy chain comprising the amino acid sequence of SEQ ID NO: 160, and a light chain comprising the amino acid sequence of SEQ ID NO: 161. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the K$_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and wherein the full-length antibody comprises a heavy chain comprising the amino acid sequence of SEQ ID NO: 308, and a light chain comprising the amino acid sequence of SEQ ID NO: 309. In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions, and wherein the full-length antibody comprises a heavy chain comprising the amino acid sequence of SEQ ID NO: 308, and a light chain comprising the amino acid sequence of SEQ ID NO: 309. In some embodiments, the amino acid substitutions are in CDR1 and/or CDR2. In some embodiments, there is provided an isolated anti-CTLA-4 construct comprising a sdAb moiety specifically recognizing CTLA-4 and an anti-PD-1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262, and wherein the full-length antibody comprises a heavy chain comprising the amino acid sequence of SEQ ID NO: 308, and a light chain comprising the amino acid sequence of SEQ ID NO: 309. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353, and wherein the full-length antibody comprises a heavy chain comprising the amino acid sequence of SEQ ID NO: 308, and a light chain comprising the amino acid sequence of SEQ ID NO: 309. In some embodiments, there is provided an isolated anti-CTLA-4 construct comprising a sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_HH$ domain, and wherein the full-length antibody comprises a heavy chain comprising the amino acid sequence of SEQ ID NO: 308, and a light chain comprising the amino acid sequence of SEQ ID NO: 309. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in CDRs, such as the CDR1, and/or the CDR2, and/or the CDR3 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises CDR1, CDR2, and CDR3 of any one of SEQ ID NOs: 113-129, 200-202, 274-282, 341-344, 352, and 353, and the amino acid substitutions are in FRs, such as the FR1, and/or the FR2, and/or the FR3, and/or the FR4 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in both CDRs and FRs. In some embodiments, there is provided an isolated anti-CTLA-4 construct comprising a sdAb moiety specifically recognizing CTLA-4 and an anti-PD-1 full-length antibody, wherein the sdAb comprises a $V_HH$ domain comprising the amino acid sequence of any one of SEQ ID NOs: 113-129, 200-202, 274-282, 341-344, 352, and 353, and wherein the full-length antibody comprises a heavy chain comprising the amino acid sequence of SEQ ID NO: 308, and a light chain comprising the amino acid sequence of SEQ ID NO: 309. In some embodiments, there is provided an isolated anti-CTLA-4 construct comprising a sdAb moiety specifically recognizing CTLA-4 and an anti-PD-1 full-length antibody, wherein the sdAb moiety comprises CDR1, CDR2, and CDR3 of any one of SEQ ID NOs: 113-129, 200-202, 274-282, 341-344, 352, and 353, and wherein the full-length antibody comprises a heavy chain comprising the amino acid sequence of SEQ ID NO: 308, and a light chain comprising the amino acid sequence of SEQ ID NO: 309. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

Figure 40:
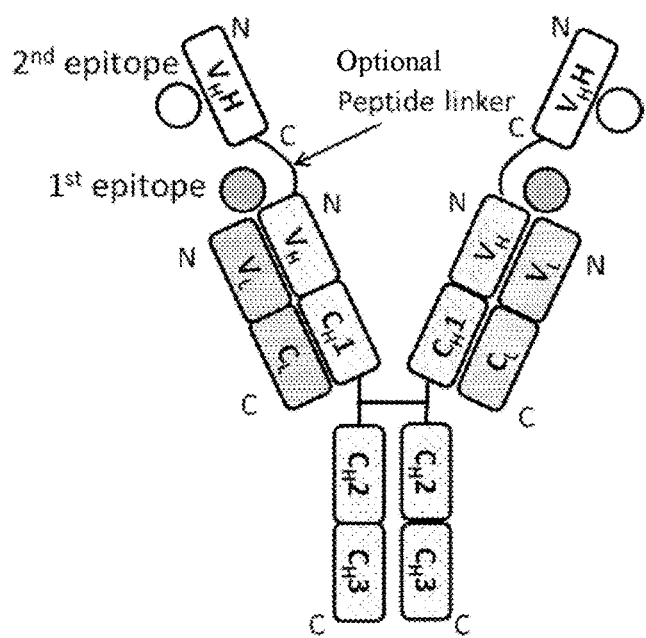
FIG. 40 depicts a schematic structure of an exemplary BABP comprising a monospecific full-length antibody having two identical heavy chains and two identical light chains, and two identical sdAbs, wherein the C-terminus of each sdAb is fused to the N-terminus of one heavy chain. The full-length antibody has two antigen binding sites that specifically bind a first epitope. The two sdAbs specifically bind the second epitope. For example, the BABP can consist of four polypeptide chains with structures from the N-terminus to the C-terminus as follows: (1) $V_L$-$C_L$; (2) $V_HH$-$V_H$-$C_H1$-$C_H2$-$C_H3$; (3) $V_HH$-$V_H$-$V_H$-$C_H1$-$C_H2$-$C_H3$; and (4) $V_L$-$C_L$, wherein $V_H$ and $V_L$ of polypeptide chains (1) and (2) forms an antigen binding site that specifically binds a first copy of the first epitope, $V_H$ and $V_L$ of polypeptide chains (3) and (4) forms an antigen binding site that specifically binds a second copy of the first epitope, and each $V_HH$ specifically binds a copy of the second epitope. In alternative formats, each sdAb may be omitted, or replaced with two identical or different sdAbs fused to each other. The monospecific full-length antibody may be replaced with a bispecific full-length antibody to further expand binding specificity.
Figure 41:
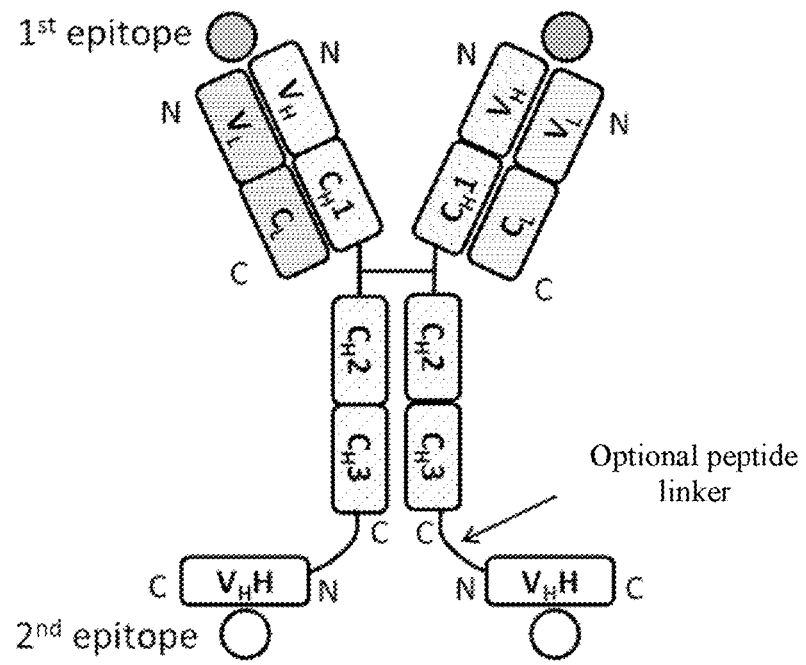
FIG. 41 depicts a schematic structure of an exemplary BABP comprising a monospecific full-length antibody having two identical heavy chains and two identical light chains, and two identical sdAbs, wherein the N-terminus of each sdAb is fused to the C-terminus of one heavy chain via an optional peptide linker. The full-length antibody has two antigen binding sites that specifically bind a first epitope. The two sdAbs specifically bind the second epitope. For example, the BABP can consist of four polypeptide chains with structures from the N-terminus to the C-terminus as follows: (1) $V_L$-$C_L$; (2) $V_H$-$C_H1$-$C_H2$-$C_H3$-$V_HH$; (3) $V_H$-$C_H1$-$C_H2$-$C_H3$-$V_HH$; and (4) $V_L$-$C_L$, wherein $V_H$ and $V_L$ of polypeptide chains (1) and (2) forms an antigen binding site that specifically binds a first copy of the first epitope, $V_H$ and $V_L$ of polypeptide chains (3) and (4) forms an antigen binding site that specifically binds a second copy of the first epitope, and each $V_H H$ specifically binds a copy of the second epitope. In alternative formats, each sdAb may be omitted, or replaced with two copies of the sdAb fused to each other. The monospecific full-length antibody may be replaced with a bispecific full-length antibody to further expand binding specificity.

In some embodiments, there is provided an isolated anti-CTLA-4 construct comprising a sdAb moiety specifically recognizing CTLA-4 and an anti-PD-1 full-length antibody, wherein the full-length antibody comprises a heavy chain comprising the amino acid sequence of SEQ ID NO: 158, and a light chain comprising the amino acid sequence of SEQ ID NO: 159, wherein at least one of the heavy chains of the full-length antibody is fused to the anti-CTLA-4 sdAb, and wherein the heavy chain fusion polypeptide comprises the amino acid sequence of any one of SEQ ID NOs: 134-145, 292-296, and 319-323. In some embodiments, there is provided an isolated anti-CTLA-4 construct comprising two sdAb moieties specifically recognizing CTLA-4 and an anti-PD-1 full-length antibody, wherein the full-length antibody comprises a heavy chain comprising the amino acid sequence of SEQ ID NO: 158, and a light chain comprising the amino acid sequence of SEQ ID NO: 159, wherein each heavy chain of the full-length antibody is fused to an anti-CTLA-4 sdAb, and wherein the heavy chain fusion polypeptide comprises the amino acid sequence of any one of SEQ ID NOs: 134-145, 292-296, and 319-323. In some embodiments, there is provided an isolated anti-CTLA-4 construct comprising two identical copies of heavy chain fusion polypeptide comprising the amino acid sequence of any one of SEQ ID NOs: 134-145, 292-296, and 319-323, and two identical copies of light chain comprising the amino acid sequence of SEQ ID NO: 159. In some embodiments, the anti-CTLA-4 construct has the structure as shown in FIG. 40 and FIG. 41.

In some embodiments, there is provided an isolated anti-CTLA-4 construct comprising a sdAb moiety specifically recognizing CTLA-4 and an anti-PD-1 full-length antibody, wherein the full-length antibody comprises a heavy chain comprising the amino acid sequence of SEQ ID NO: 160, and a light chain comprising the amino acid sequence of SEQ ID NO: 161, wherein at least one of the heavy chains of the full-length antibody is fused to the anti-CTLA-4 sdAb, and wherein the heavy chain fusion polypeptide comprises the amino acid sequence of any one of SEQ ID NOs: 146-157, 297-301, and 324-328. In some embodiments, there is provided an isolated anti-CTLA-4 construct comprising two sdAb moieties specifically recognizing CTLA-4 and an anti-PD-1 full-length antibody, wherein the full-length antibody comprises a heavy chain comprising the amino acid sequence of SEQ ID NO: 160, and a light chain comprising the amino acid sequence of SEQ ID NO: 161, wherein each heavy chain of the full-length antibody is fused to an anti-CTLA-4 sdAb, and wherein the heavy chain fusion polypeptide comprises the amino acid sequence of any one of SEQ ID NOs: 146-157, 297-301, and 324-328. In some embodiments, there is provided an isolated anti-CTLA-4 construct comprising two identical copies of heavy chain fusion polypeptide comprising the amino acid sequence of any one of SEQ ID NOs: 146-157, 297-301, and 324-328, and two identical copies of light chain comprising the amino acid sequence of SEQ ID NO: 161. In some embodiments, the anti-CTLA-4 construct has the structure as shown in FIG. 40 and FIG. 41.

In some embodiments, there is provided an isolated anti-CTLA-4 construct comprising a sdAb moiety specifically recognizing CTLA-4 and an anti-PD-1 full-length antibody, wherein the full-length antibody comprises a heavy chain comprising the amino acid sequence of SEQ ID NO: 308, and a light chain comprising the amino acid sequence of SEQ ID NO: 309, wherein at least one of the heavy chains of the full-length antibody is fused to the anti-CTLA-4 sdAb, and wherein the heavy chain fusion polypeptide comprises the amino acid sequence of any one of SEQ ID NOs: 310-318 and 329-337. In some embodiments, there is provided an isolated anti-CTLA-4 construct comprising two sdAb moieties specifically recognizing CTLA-4 and an anti-PD-1 full-length antibody, wherein the full-length antibody comprises a heavy chain comprising the amino acid sequence of SEQ ID NO: 308, and a light chain comprising the amino acid sequence of SEQ ID NO: 309, wherein each heavy chain of the full-length antibody is fused to an anti-CTLA-4 sdAb, and wherein the heavy chain fusion polypeptide comprises the amino acid sequence of any one of SEQ ID NOs: 310-318 and 329-337. In some embodiments, there is provided an isolated anti-CTLA-4 construct comprising two identical copies of heavy chain fusion polypeptide comprising the amino acid sequence of any one of SEQ ID NOs: 310-318 and 329-337, and two identical copies of light chain comprising the amino acid sequence of SEQ ID NO: 309. In some embodiments, the anti-CTLA-4 construct has the structure as shown in FIG. 40 and FIG. 41.

Figure 42:
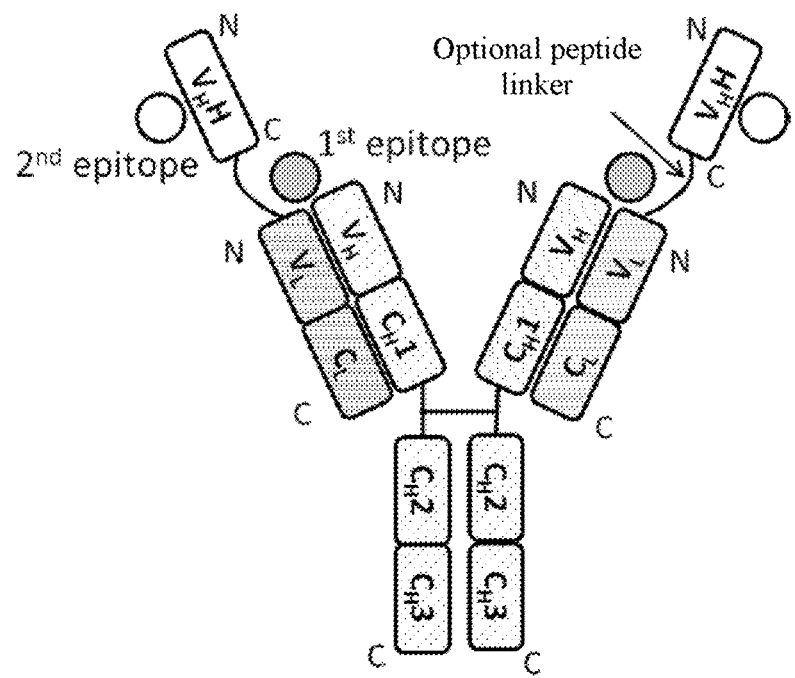
FIG. 42 depicts a schematic structure of an exemplary BABP comprising a monospecific full-length antibody having two identical heavy chains and two identical light chains, and two identical sdAbs, wherein the C-terminus of each sdAb is fused to the N-terminus of one light chain via an optional peptide linker. The full-length antibody has two antigen binding sites that specifically bind a first epitope. The two sdAbs specifically bind the second epitope. For example, the BABP can consist of four polypeptide chains with structures from the N-terminus to the C-terminus as follows: (1) $V_H H\text{-}V_L\text{-}C_L$; (2) $V_H\text{-}C_H 1\text{-}C_H 2\text{-}C_H 3$; (3) $V_H\text{-}C_H 1\text{-}C_H 2\text{-}C_H 3$; and (4) $V_H H\text{-}V_L\text{-}C_L$, wherein $V_H$ and $V_L$ of polypeptide chains (1) and (2) forms an antigen binding site that specifically binds a first copy of the first epitope, $V_H$ and $V_L$ of polypeptide chains (3) and (4) forms an antigen binding site that specifically binds a second copy of the first epitope, and each $V_H H$ specifically binds a copy of the second epitope. In alternative formats, each sdAb may be omitted, or replaced with two identical or different sdAbs fused to each other. The monospecific full-length antibody may be replaced with a bispecific full-length antibody to further expand binding specificity.
Figure 43:
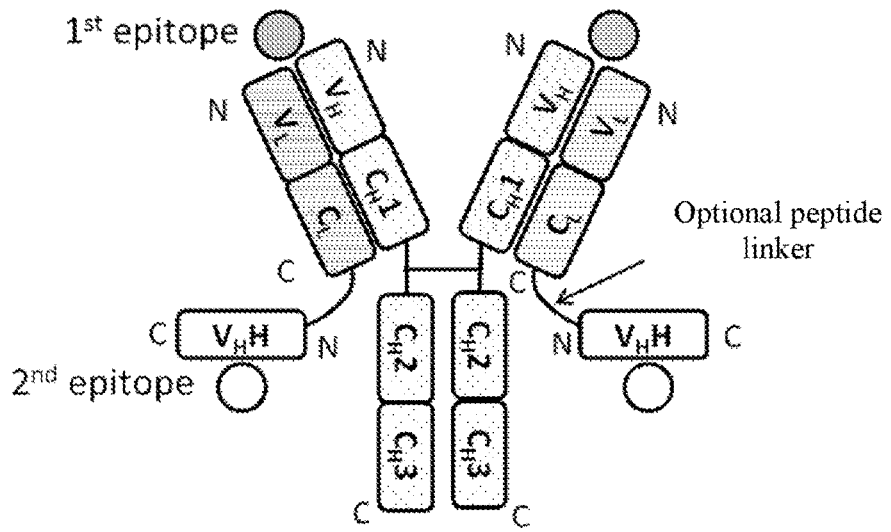
FIG. 43 depicts a schematic structure of an exemplary BABP comprising a monospecific full-length antibody having two identical heavy chains and two identical light chains, and two identical sdAbs, wherein the N-terminus of each sdAb is fused to the C-terminus of one light chain via an optional peptide linker. The full-length antibody has two antigen binding sites that specifically bind a first epitope. The two sdAbs specifically bind the second epitope. For example, the BABP can consist of four polypeptide chains with structures from the N-terminus to the C-terminus as follows: (1) $V_L\text{-}C_L\text{-}V_H H$; (2) $V_H\text{-}C_H 1\text{-}C_H 2\text{-}C_H 3$; (3) $V_H\text{-}C_H 1\text{-}C_H 2\text{-}C_H 3$; and (4) $V_L\text{-}C_L\text{-}V_H H$, wherein $V_H$ and $V_L$ of polypeptide chains (1) and (2) forms an antigen binding site that specifically binds a first copy of the first epitope, $V_H$ and $V_L$ of polypeptide chains (3) and (4) forms an antigen binding site that specifically binds a second copy of the first epitope, and each $V_H H$ specifically binds a copy of the second epitope. In alternative formats, each sdAb may be omitted, or replaced with two identical or different sdAbs fused to each other. The monospecific full-length antibody may be replaced with a bispecific full-length antibody to further expand binding specificity.

In some embodiments, there is provided an isolated anti-CTLA-4 construct comprising a sdAb moiety specifically recognizing CTLA-4 and an anti-PD-1 full-length antibody, wherein the full-length antibody comprises a heavy chain comprising the amino acid sequence of SEQ ID NO: 158, and a light chain comprising the amino acid sequence of SEQ ID NO: 159, wherein at least one of the light chains of the full-length antibody is fused to the anti-CTLA-4 sdAb, and wherein the light chain fusion polypeptide comprises the amino acid sequence of any one of SEQ ID NOs: 354 and 355. In some embodiments, there is provided an isolated anti-CTLA-4 construct comprising two sdAb moieties specifically recognizing CTLA-4 and an anti-PD-1 full-length antibody, wherein the full-length antibody comprises a heavy chain comprising the amino acid sequence of SEQ ID NO: 158, and a light chain comprising the amino acid sequence of SEQ ID NO: 159, wherein each light chain of the full-length antibody is fused to an anti-CTLA-4 sdAb, and wherein the light chain fusion polypeptide comprises the amino acid sequence of any one of SEQ ID NOs: 354 and 355. In some embodiments, there is provided an isolated anti-CTLA-4 construct comprising two identical copies of heavy chain comprising the amino acid sequence of SEQ ID NO: 158, and two identical copies of light chain fusion polypeptide comprising the amino acid sequence of any one of SEQ ID NOs: 354 and 355. In some embodiments, the anti-CTLA-4 construct has the structure as shown in FIG. 42 and FIG. 43.

Figure 44:
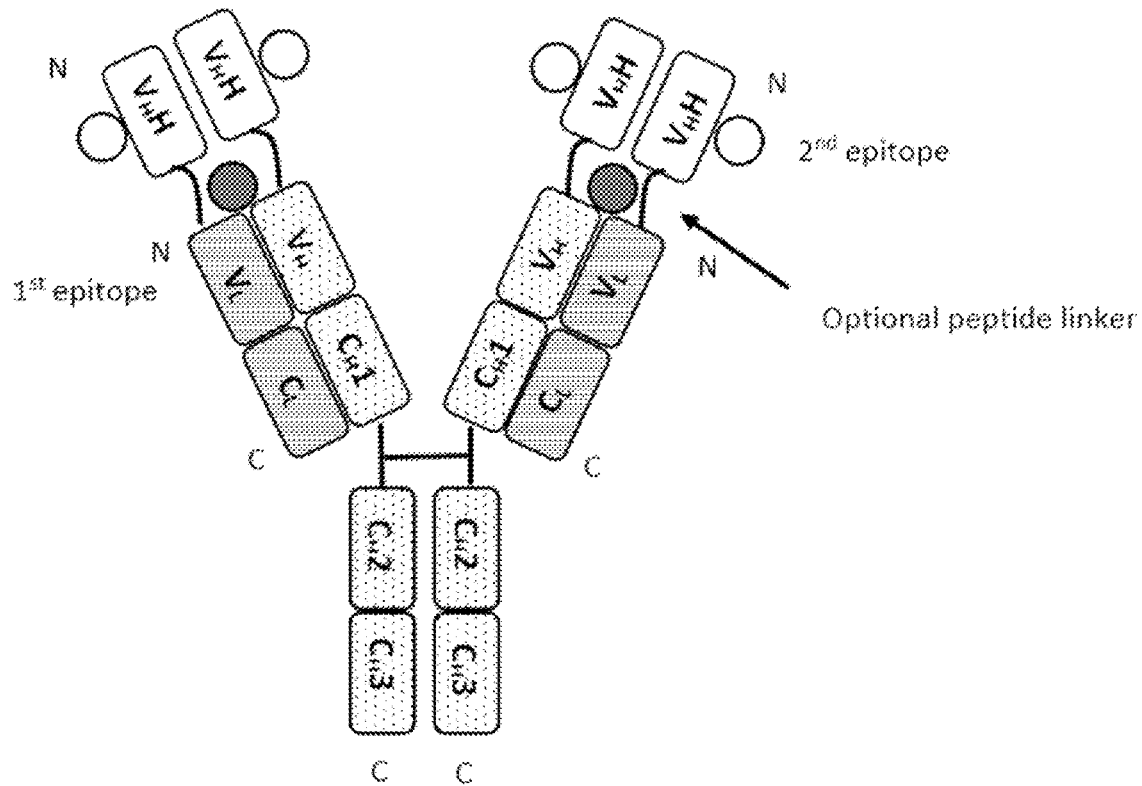
FIG. 44 depicts a schematic structure of an exemplary BABP comprising a monospecific full-length antibody having two identical heavy chains and two identical light chains, and four identical sdAbs, wherein the C-terminus of each sdAb is fused to the N-terminus of heavy chain or light chain of the monospecific full-length antibody via an optional peptide linker. The full-length antibody has two antigen binding sites that each specifically binds a first epitope. Each sdAb specifically binds to a second epitope. For example, the BABP can consist of four polypeptide chains with structures from the N-terminus to the C-terminus as follows: (1) $V_H H\text{-}V_L\text{-}C_L$; (2) $V_H H\text{-}V_H\text{-}C_H 1\text{-}C_H 2\text{-}C_H 3$; (3) $V_H H\text{-}V_H\text{-}C_H 1\text{-}C_H 2\text{-}C_H 3$; and (4) $V_H H\text{-}V_L\text{-}C_L$, wherein $V_H$ and $V_L$ of polypeptide chains (1) and (2) forms an antigen binding site that specifically binds a first copy of the first epitope, $V_H$ and $V_L$ of polypeptide chains (3) and (4) forms an antigen binding site that specifically binds a second copy of the first epitope, and each $V_H H$ specifically binds a copy of the second epitope. In alternative formats, each sdAb may be omitted, or replaced with two identical or different sdAbs fused to each other. The monospecific full-length antibody may be replaced with a bispecific full-length antibody to further expand binding specificity.

In some embodiments, there is provided an isolated anti-CTLA-4 construct comprising four sdAb moieties specifically recognizing CTLA-4 described herein and an anti-PD-1 full-length antibody, wherein the C-terminus of each anti-CTLA-4 sdAb is fused to the N-terminus of each chain of the full-length antibody. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the four anti-CTLA-4 sdAbs are identical. In some embodiments, the full-length antibody comprises a heavy chain comprising the amino acid sequence of SEQ ID NO: 158, and a light chain comprising the amino acid sequence of SEQ ID NO: 159. In some embodiments, there is provided an isolated anti-CTLA-4 construct comprising two identical copies of heavy chain fusion polypeptide comprising the amino acid sequence of SEQ ID NO: 356, and two identical copies of light chain fusion polypeptide comprising the amino acid sequence of SEQ ID NO: 357. In some embodiments, the anti-CTLA-4 construct has the structure as shown in FIG. 44.

Figure 45:
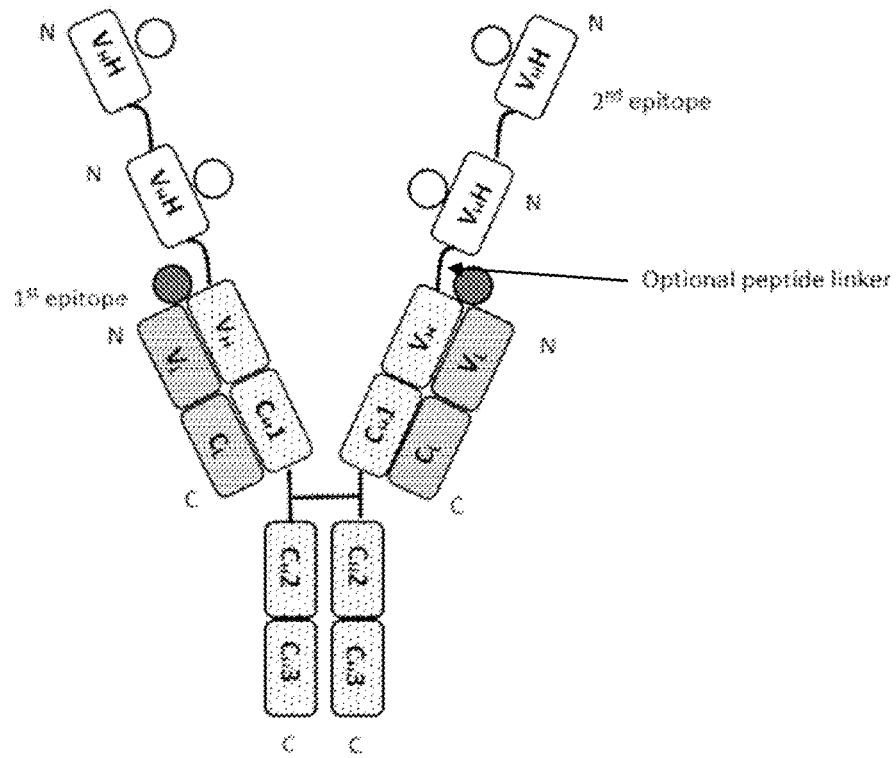
FIG. 45 depicts a schematic structure of an exemplary BABP comprising a monospecific full-length antibody having two identical heavy chains and two identical light chains, and four identical sdAbs, wherein fused to the N-terminus of each heavy chain are two identical sdAbs, the two sdAbs are fused to each other via an optional peptide linker, and the two sdAbs are fused to the N-terminus of each heavy chain via an optional peptide linker. The full-length antibody has two antigen binding sites that each specifically binds a first epitope. Each sdAb specifically binds a second epitope. For example, the BABP can consist of four polypeptide chains with structures from the N-terminus to the C-terminus as follows: (1) $V_L\text{-}C_L$; (2) $V_H H\text{-}V_H H\text{-}V_H\text{-}C_H 1\text{-}C_H 2\text{-}C_H 3$; (3) $V_H H\text{-}V_H H\text{-}V_H\text{-}C_H 1\text{-}C_H 2\text{-}C_H 3$; and (4) $V_L\text{-}C_L$, wherein $V_H$ and $V_L$ of polypeptide chains (1) and (2) forms an antigen binding site that specifically binds a first copy of the first epitope, $V_H$ and $V_L$ of polypeptide chains (3) and (4) forms an antigen binding site that specifically binds a second copy of the first epitope, and each $V_H H$ specifically binds a copy of the second epitope. In alternative formats, each sdAb may be omitted, or replaced with two identical or different sdAbs fused to each other. The monospecific full-length antibody may be replaced with a bispecific full-length antibody to further expand binding specificity.

In some embodiments, there is provided an isolated anti-CTLA-4 construct comprising four sdAb moieties specifically recognizing CTLA-4 described herein and an anti-PD-1 full-length antibody, wherein two anti-CTLA-4 sdAbs are fused together, the other two anti-CTLA-4 sdAbs are fused together, wherein the N-terminus of each heavy chain of the full-length antibody is fused to the C-terminus of each anti-CTLA-4 sdAb fusion. In some embodiments, the sdAb moiety specifically recognizing CTLA-4 and the full-length antibody are optionally connected by a peptide linker. In some embodiments, the two sdAb moieties specifically recognizing CTLA-4 are optionally connected by a peptide linker. In some embodiments, the peptide linker comprises the amino acid sequence of SEQ ID NO: 162, 163, 307, or 365. In some embodiments, the four anti-CTLA-4 sdAbs are identical. In some embodiments, the full-length antibody comprises a heavy chain comprising the amino acid sequence of SEQ ID NO: 158, and a light chain comprising the amino acid sequence of SEQ ID NO: 159. In some embodiments, there is provided an isolated anti-CTLA-4 construct comprising two identical copies of heavy chain fusion polypeptide comprising the amino acid sequence of SEQ ID NO: 358, and two identical copies of light chain comprising the amino acid sequence of SEQ ID NO: 159. In some embodiments, the anti-CTLA-4 construct has the structure as shown in FIG. 45.

In some embodiments, there is provided an isolated anti-CTLA-4 construct comprising a sdAb moiety specifically recognizing CTLA-4 and an anti-PD-L1 full-length antibody, wherein the anti-CTLA-4 sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, there is provided an isolated anti-CTLA-4 construct comprising a sdAb moiety specifically recognizing CTLA-4 and an anti-PD-L1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions. In some embodiments, the amino acid substitutions are in CDR1 and/or CDR2. In some embodiments, there is provided an isolated anti-CTLA-4 construct comprising a sdAb moiety specifically recognizing CTLA-4 and an anti-PD-L1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the full-length antibody comprises a heavy chain comprising the amino acid sequence of SEQ ID NO: 195, and a light chain comprising the amino acid sequence of SEQ ID NO: 196, wherein at least one of the heavy chains of the full-length antibody is fused to the anti-CTLA-4 sdAb, and wherein the heavy chain fusion polypeptide comprises the amino acid sequence of any one of SEQ ID NOs: 171-182, 302-306, and 345-349. In some embodiments, the full-length antibody comprises a heavy chain comprising the amino acid sequence of SEQ ID NO: 197, and a light chain comprising the amino acid sequence of SEQ ID NO: 198, wherein at least one of the heavy chains of the full-length antibody is fused to the anti-CTLA-4 sdAb, and wherein the heavy chain fusion polypeptide comprises the amino acid sequence of any one of SEQ ID NOs: 183-194.

In some embodiments, there is provided an isolated anti-CTLA-4 construct comprising a sdAb moiety specifically recognizing CTLA-4 and an anti-PD-L1 full-length antibody, wherein the sdAb comprises a $V_HH$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353. In some embodiments, there is provided an isolated anti-CTLA-4 construct comprising a sdAb moiety specifically recognizing CTLA-4 and an anti-PD-L1 full-length antibody, wherein the sdAb comprises a $V_HH$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_HH$ domain. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in CDRs, such as the CDR1, and/or the CDR2, and/or the CDR3 of any one of SEQ ID NOs: 113-129, 200-202, 274-282, 341-344, 352, and 353. In some embodiments, the anti-CTLA-4 sdAb moiety comprising the V$_H$H domain comprising the amino acid sequence of any one of SEQ ID NOs: 113-129, 200-202, 274-282, 341-344, 352, and 353 or a variant thereof comprises CDR1, CDR2, and CDR3 of any one of SEQ ID NOs: 113-129, 200-202, 274-282, 341-344, 352, and 353, and the amino acid substitutions are in FRs, such as the FR1, and/or the FR2, and/or the FR3, and/or the FR4 of any one of SEQ ID NOs: 113-129, 200-202, 274-282, 341-344, 352, and 353. In some embodiments, the anti-CTLA-4 sdAb moiety comprising the V$_H$H domain comprising the amino acid sequence of any one of SEQ ID NOs: 113-129, 200-202, 274-282, 341-344, 352, and 353 or a variant thereof comprises amino acid substitutions in both CDRs and FRs. In some embodiments, there is provided an isolated anti-CTLA-4 construct comprising a sdAb moiety specifically recognizing CTLA-4 and an anti-PD-L1 full-length antibody, wherein the sdAb comprises a V$_H$H domain comprising the amino acid sequence of any one of SEQ ID NOs: 113-129, 200-202, 274-282, 341-344, 352, and 353. In some embodiments, there is provided an isolated anti-CTLA-4 construct comprising a sdAb moiety specifically recognizing CTLA-4 and an anti-PD-L1 full-length antibody, wherein the sdAb moiety comprises CDR1, CDR2, and CDR3 of any one of SEQ ID NOs: 113-129, 200-202, 274-282, 341-344, 352, and 353. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the K$_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-L1 full-length antibody, wherein the anti-CTLA-4 sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and wherein the full-length antibody comprises a heavy chain comprising the amino acid sequence of SEQ ID NO: 195, and a light chain comprising the amino acid sequence of SEQ ID NO: 196. In some embodiments, there is provided an isolated anti-CTLA-4 construct comprising a sdAb moiety specifically recognizing CTLA-4 and an anti-PD-L1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions, and wherein the full-length antibody comprises a heavy chain comprising the amino acid sequence of SEQ ID NO: 195, and a light chain comprising the amino acid sequence of SEQ ID NO: 196. In some embodiments, the amino acid substitutions are in CDR1 and/or CDR2. In some embodiments, there is provided an isolated anti-CTLA-4 construct comprising a sdAb moiety specifically recognizing CTLA-4 and an anti-PD-L1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262, and wherein the full-length antibody comprises a heavy chain comprising the amino acid sequence of SEQ ID NO: 195, and a light chain comprising the amino acid sequence of SEQ ID NO: 196. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-L1 full-length antibody, wherein the sdAb comprises a $V_HH$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353, and wherein the full-length antibody comprises a heavy chain comprising the amino acid sequence of SEQ ID NO: 195, and a light chain comprising the amino acid sequence of SEQ ID NO: 196. In some embodiments, there is provided an isolated anti-CTLA-4 construct comprising a sdAb moiety specifically recognizing CTLA-4 and an anti-PD-L1 full-length antibody, wherein the sdAb comprises a $V_HH$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_HH$ domain, and wherein the full-length antibody comprises a heavy chain comprising the amino acid sequence of SEQ ID NO: 195, and a light chain comprising the amino acid sequence of SEQ ID NO: 196. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in CDRs, such as the CDR1, and/or the CDR2, and/or the CDR3 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises CDR1, CDR2, and CDR3 of any one of SEQ ID NOs: 113-129, 200-202, 274-282, 341-344, 352, and 353, and the amino acid substitutions are in FRs, such as the FR1, and/or the FR2, and/or the FR3, and/or the FR4 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in both CDRs and FRs. In some embodiments, there is provided an isolated anti-CTLA-4 construct comprising a sdAb moiety specifically recognizing CTLA-4 and an anti-PD-L1 full-length antibody, wherein the sdAb comprises a $V_HH$ domain comprising the amino acid sequence of any one of SEQ ID NOs: 113-129, 200-202, 274-282, 341-344, 352, and 353, and wherein the full-length antibody comprises a heavy chain comprising the amino acid sequence of SEQ ID NO: 195, and a light chain comprising the amino acid sequence of SEQ ID NO: 196. In some embodiments, there is provided an isolated anti-CTLA-4 construct comprising a sdAb moiety specifically recognizing CTLA-4 and an anti-PD-L1 full-length antibody, wherein the sdAb moiety comprises CDR1, CDR2, and CDR3 of any one of SEQ ID NOs: 113-129, 200-202, 274-282, 341-344, 352, and 353, and wherein the full-length antibody comprises a heavy chain comprising the amino acid sequence of SEQ ID NO: 195, and a light chain comprising the amino acid sequence of SEQ ID NO: 196. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-L1 full-length antibody, wherein the anti-CTLA-4 sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and wherein the full-length antibody comprises a heavy chain comprising the amino acid sequence of SEQ ID NO: 197, and a light chain comprising the amino acid sequence of SEQ ID NO: 198. In some embodiments, there is provided an isolated anti-CTLA-4 construct comprising a sdAb moiety specifically recognizing CTLA-4 and an anti-PD-L1 full-length antibody, wherein the anti- CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions, and wherein the full-length antibody comprises a heavy chain comprising the amino acid sequence of SEQ ID NO: 197, and a light chain comprising the amino acid sequence of SEQ ID NO: 198. In some embodiments, the amino acid substitutions are in CDR1 and/or CDR2. In some embodiments, there is provided an isolated anti-CTLA-4 construct comprising a sdAb moiety specifically recognizing CTLA-4 and an anti-PD-L1 full-length antibody, wherein the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262, and wherein the full-length antibody comprises a heavy chain comprising the amino acid sequence of SEQ ID NO: 197, and a light chain comprising the amino acid sequence of SEQ ID NO: 198. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb described herein, and the C-terminus of the anti-CTLA-4 sdAbs is fused to the N-terminus of both heavy and light chains of the full-length antibody. In some embodiments, the anti-CTLA-4 construct comprises four anti-CTLA-4 sdAb described herein, wherein two anti-CTLA-4 sdAbs are fused together via a first optional linker, the other two anti-CTLA-4 sdAbs are fused together via a second optional linker, wherein the C-terminus of each set of two anti-CTLA-4 sdAb fusion is fused to the N-terminus of the heavy chains of the full-length antibody (exemplified as FIG. 45). In some embodiments, the four anti-CTLA-4 sdAbs are identical. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-L1 full-length antibody, wherein the sdAb comprises a $V_HH$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353, and wherein the full-length antibody comprises a heavy chain comprising the amino acid sequence of SEQ ID NO: 197, and a light chain comprising the amino acid sequence of SEQ ID NO: 198. In some embodiments, there is provided an isolated anti-CTLA-4 construct comprising a sdAb moiety specifically recognizing CTLA-4 and an anti-PD-L1 full-length antibody, wherein the sdAb comprises a $V_HH$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_HH$ domain, and wherein the full-length antibody comprises a heavy chain comprising the amino acid sequence of SEQ ID NO: 197, and a light chain comprising the amino acid sequence of SEQ ID NO: 198. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in CDRs, such as the CDR1, and/or the CDR2, and/or the CDR3 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises CDR1, CDR2, and CDR3 of any one of SEQ ID NOs: 113-129, 200-202, 274-282, 341-344, 352, and 353, and the amino acid substitutions are in FRs, such as the FR1, and/or the FR2, and/or the FR3, and/or the FR4 of any one of SEQ ID NOs: 113-129, 200-202, 274-282, 341-344, 352, and 353. In some embodiments, the anti-CTLA-4 sdAb moiety comprising the $V_HH$ domain comprising the amino acid sequence of any one of SEQ ID NOs: 113-129, 200-202, 274-282, 341-344, 352, and 353 or a variant thereof comprises amino acid substitutions in both CDRs and FRs. In some embodiments, there is provided an isolated anti-CTLA-4 construct comprising a sdAb moiety specifically recognizing CTLA-4 and an anti-PD-L1 full-length antibody, wherein the sdAb comprises a $V_HH$ domain comprising the amino acid sequence of any one of SEQ ID NOs: 113-129, 200-202, 274-282, 341-344, 352, and 353, and wherein the full-length antibody comprises a heavy chain comprising the amino acid sequence of SEQ ID NO: 197, and a light chain comprising the amino acid sequence of SEQ ID NO: 198. In some embodiments, there is provided an isolated anti-CTLA-4 construct comprising a sdAb moiety specifically recognizing CTLA-4 and an anti-PD-L1 full-length antibody, wherein the sdAb moiety comprises CDR1, CDR2, and CDR3 of any one of SEQ ID NOs: 113-129, 200-202, 274-282, 341-344, 352, and 353, and wherein the full-length antibody comprises a heavy chain comprising the amino acid sequence of SEQ ID NO: 197, and a light chain comprising the amino acid sequence of SEQ ID NO: 198. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an isolated anti-CTLA-4 construct comprising a sdAb moiety specifically recognizing CTLA-4 and an anti-PD-L1 full-length antibody, wherein the full-length antibody comprises a heavy chain comprising the amino acid sequence of SEQ ID NO: 195, and a light chain comprising the amino acid sequence of SEQ ID NO: 196, wherein at least one of the heavy chains of the full-length antibody is fused to the anti-CTLA-4 sdAb, and wherein the heavy chain fusion polypeptide comprises the amino acid sequence of any one of SEQ ID NOs: 171-182, 302-306, and 345-349. In some embodiments, there is provided an isolated anti-CTLA-4 construct comprising two sdAb moieties specifically recognizing CTLA-4 and an anti-PD-L1 full-length antibody, wherein the full-length antibody comprises a heavy chain comprising the amino acid sequence of SEQ ID NO: 195, and a light chain comprising the amino acid sequence of SEQ ID NO: 196, wherein each heavy chain of the full-length antibody is fused to an anti-CTLA-4 sdAb, and wherein the heavy chain fusion polypeptide comprises the amino acid sequence of any one of SEQ ID NOs: 171-182, 302-306, and 345-349. In some embodiments, there is provided an isolated anti-CTLA-4 construct comprising two identical copies of heavy chain fusion polypeptide comprising the amino acid sequence of any one of SEQ ID NOs: 171-182, 302-306, and 345-349, and two identical copies of light chain comprising the amino acid sequence of SEQ ID NO: 196. In some embodiments, the anti-CTLA-4 construct has the structure as shown in FIG. 40 and FIG. 41.

In some embodiments, there is provided an isolated anti-CTLA-4 construct comprising a sdAb moiety specifically recognizing CTLA-4 and an anti-PD-L1 full-length antibody, wherein the full-length antibody comprises a heavy chain comprising the amino acid sequence of SEQ ID NO: 197, and a light chain comprising the amino acid sequence of SEQ ID NO: 198, wherein at least one of the heavy chains of the full-length antibody is fused to the anti-CTLA-4 sdAb, and wherein the heavy chain fusion polypeptide comprises the amino acid sequence of any one of SEQ ID NOs: 183-194. In some embodiments, there is provided an isolated anti-CTLA-4 construct comprising two sdAb moieties specifically recognizing CTLA-4 and an anti-PD-L1 full-length antibody, wherein the full-length antibody comprises a heavy chain comprising the amino acid sequence of SEQ ID NO: 197, and a light chain comprising the amino acid sequence of SEQ ID NO: 198, wherein each heavy chain of the full-length antibody is fused to an anti-CTLA-4 sdAb, and wherein the heavy chain fusion polypeptide comprises the amino acid sequence of any one of SEQ ID NOs: 183-194. In some embodiments, there is provided an isolated anti-CTLA-4 construct comprising two identical copies of heavy chain fusion polypeptide comprising the amino acid sequence of any one of SEQ ID NOs: 183-194, and two identical copies of light chain comprising the amino acid sequence of SEQ ID NO: 198. In some embodiments, the anti-CTLA-4 construct has the structure as shown in FIG. 40 and FIG. 41.

In some embodiments, there is provided an isolated anti-CTLA-4 construct comprising an sdAb moiety specifically recognizing CTLA-4 described herein and an anti-PD-L1 full-length antibody, wherein at least one of the light chains of the full-length antibody is fused to the anti-CTLA-4 sdAb. In some embodiments, there is provided an isolated anti-CTLA-4 construct comprising two sdAb moieties specifically recognizing CTLA-4 described herein and an anti-PD-L1 full-length antibody, wherein each light chain of the full-length antibody is fused to an anti-CTLA-4 sdAb. In some embodiments, the isolated anti-CTLA-4 construct comprises two identical copies of full-length antibody heavy chains, and two identical copies of light chain fusion polypeptide comprising the full-length antibody light chain and the anti-CTLA-4 sdAb. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the anti-CTLA-4 construct has the structure as shown in FIG. 42 and FIG. 43.

In some embodiments, there is provided an isolated anti-CTLA-4 construct comprising four sdAb moieties specifically recognizing CTLA-4 described herein and an anti-PD-L1 full-length antibody, wherein the C-terminus of each anti-CTLA-4 sdAb is fused to the N-terminus of each chain of the full-length antibody. In some embodiments, the sdAb moiety specifically recognizing CTLA-4 and the full-length antibody are optionally connected by a peptide linker. In some embodiments, the peptide linker comprises the amino acid sequence of SEQ ID NO: 162, 163, 307, or 365. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the isolated anti-CTLA-4 construct comprises two identical copies of heavy chain fusion polypeptide comprising a full-length antibody heavy chain and an anti-CTLA-4 sdAb, and two identical copies of light chain fusion polypeptide comprising a full-length antibody light chain and an anti-CTLA-4 sdAb. In some embodiments, the four anti-CTLA-4 sdAbs are identical. In some embodiments, the anti-CTLA-4 construct has the structure as shown in FIG. 44.

In some embodiments, there is provided an isolated anti-CTLA-4 construct comprising four sdAb moieties specifically recognizing CTLA-4 described herein and an anti-PD-L1 full-length antibody, wherein two anti-CTLA-4 sdAbs are fused together, the other two anti-CTLA-4 sdAbs are fused together, wherein the N-terminus of each heavy chain of the full-length antibody is fused to the C-terminus of each anti-CTLA-4 sdAb fusion. In some embodiments, the sdAb moiety specifically recognizing CTLA-4 and the full-length antibody are optionally connected by a peptide linker. In some embodiments, the two sdAb moieties specifically recognizing CTLA-4 are optionally connected by a peptide linker. In some embodiments, the peptide linker comprises the amino acid sequence of SEQ ID NO: 162, 163, 307, or 365. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the isolated anti-CTLA-4 construct comprises two identical copies of heavy chain fusion polypeptide comprising a full-length antibody heavy chain and a fusion of two anti-CTLA-4 sdAbs, and two identical copies of full-length antibody light chain. In some embodiments, the four anti-CTLA-4 sdAbs are identical. In some embodiments, the anti-CTLA-4 construct has the structure as shown in FIG. 45.

In some embodiments, there is also provided an anti-CTLA-4 construct comprising an sdAb moiety specifically recognizing CTLA-4 (hereinafter referred to as "competing anti-CTLA-4 construct") that specifically binds to CTLA-4 competitively with any one of the anti-CTLA-4 construct described herein (such as anti-CTLA-4 sdAb, anti-CTLA-4 HCAb, multispecific or monospecific anti-CTLA-4 construct comprising an anti-CTLA-4 sdAb descried herein, e.g., anti-CTLA-4/PD-1 constructs or anti-CTLA-4/PD-L1 constructs described herein).

Anti-CTLA-4 Multispecific Antigen Binding Proteins (MABPs)

In some embodiments, there is provided an anti-CTLA-4 construct comprising an anti-CTLA-4 sdAb moiety described herein fused to a full-length antibody or antigen binding fragment that comprises a heavy chain variable domain ($V_H$) and a light chain variable domain ($V_L$), wherein the anti-CTLA-4 construct is multispecific (hereinafter referred to as "multispecific anti-CTLA-4 construct" or "anti-CTLA-4 multispecific antigen binding protein (MABP)"). In some embodiments, the anti-CTLA-4 MABP is bispecific (hereinafter referred to as "bispecific anti-CTLA-4 construct" or "anti-CTLA-4 bispecific antigen binding protein (BABP)"). The anti-CTLA-4 sdAb specifically binds CTLA-4 that is distinct from the target(s) recognized by the full-length antibody or antigen binding fragment, thereby conferring a broadened targeting capability. Due to the small size of the sdAb, in some embodiments the anti-CTLA-4 MABPs described herein can have similar molecular weight and pharmacokinetic properties compared to those of the full-length antibody or antigen binding fragment component. For example, an anti-CTLA-4 MABP can be designed by fusing one or more sdAbs to a monoclonal antibody with proven clinical efficacy and safety to provide increased clinical benefits and desirable pharmacokinetic properties without impeding the expressibility of the multispecific construct. In some embodiments, the one or more anti-CTLA-4 sdAb described herein are fused to the full-length antibody or antigen binding fragment by an optional peptide linker. The anti-CTLA-4 MABPs described herein can be adopted to target a variety of disease-related epitope or antigen combinations besides CTLA-4, such as CTLA-4 with the combination of immune checkpoint molecules, cell surface antigens (such as tumor antigens), or pro-inflammatory molecules, thereby providing agents that are useful for treating a variety of diseases and conditions, such as cancer, inflammation, and autoimmune diseases.

Thus, in some embodiments, there is provided an anti-CTLA-4 construct (e.g., MABP or BABP) comprising: (a) a first antigen binding portion comprising an anti-CTLA-4 sdAb moiety comprising a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and (b) a second antigen binding portion comprising a heavy chain variable domain ($V_H$) and a light chain variable domain ($V_L$), wherein the $V_H$ and $V_L$ together form an antigen-binding site that specifically binds a second epitope (e.g., PD-1, PD-L1), wherein the first antigen binding portion and the second antigen binding portion are fused to each other. In some embodiments, the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 (such as about any of 1, 2, or 3) amino acid substitutions in the CDR regions. In some embodiments, the amino acid substitutions are in CDR1 and/or CDR2. In some embodiments, the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb moiety comprises a $V_H H$ domain comprising the amino acid sequence of any one of SEQ ID NOs: 113-129, 200-202, 274-282, 341-344, 352, and 353, or a variant thereof having at least about 80% (such as at least about any of 80%, 85%, 90%, 91%, 92%, 93%, 94%, 95%, 96%, 97%, 98%, or 99%) sequence identify to any one of SEQ ID NOs: 113-129, 200-202, 274-282, 341-344, 352, and 353. In some embodiments, the anti-CTLA-4 sdAb moiety comprising a $V_H H$ domain comprising the amino acid sequence of any one of SEQ ID NOs: 113-129, 200-202, 274-282, 341-344, 352, and 353, or a variant thereof comprising up to about 3 (such as about any of 1, 2, or 3) amino acid substitutions in the $V_H H$ domain. In some embodiments, the anti-CTLA-4 sdAb moiety comprising the $V_H H$ domain comprising the amino acid sequence of any one of SEQ ID NOs: 113-129, 200-202, 274-282, 341-344, 352, and 353 or a variant thereof comprises amino acid substitutions in CDRs, such as the CDR1, and/or the CDR2, and/or the CDR3 of any one of SEQ ID NOs: 113-129, 200-202, 274-282, 341-344, 352, and 353. In some embodiments, the anti-CTLA-4 sdAb moiety comprising the $V_H H$ domain comprising the amino acid sequence of any one of SEQ ID NOs: 113-129, 200-202, 274-282, 341-344, 352, and 353 or a variant thereof comprises CDR1, CDR2, and CDR3 of any one of SEQ ID NOs: 113-129, 200-202, 274-282, 341-344, 352, and 353, and the amino acid substitutions are in FRs, such as the FR1, and/or the FR2, and/or the FR3, and/or the FR4 of any one of SEQ ID NOs: 113-129, 200-202, 274-282, 341-344, 352, and 353. In some embodiments, the anti-CTLA-4 sdAb moiety comprising the $V_H H$ domain comprising the amino acid sequence of any one of SEQ ID NOs: 113-129, 200-202, 274-282, 341-344, 352, and 353 or a variant thereof comprises amino acid substitutions in both CDRs and FRs. In some embodiments, the anti-CTLA-4 sdAb moiety comprises a $V_H H$ domain comprising the amino acid sequence of any one of SEQ ID NOs: 113-129, 200-202, 274-282, 341-344, 352, and 353. In some embodiments, there is provided an anti-CTLA-4 construct (e.g., MABP or BABP) comprising: (a) a first antigen binding portion comprising an anti-CTLA-4 sdAb moiety that comprises CDR1, CDR2, and CDR3 of any one of SEQ ID NOs: 113-129, 200-202, 274-282, 341-344, 352, and 353, and (b) a second antigen binding portion comprising a heavy chain variable domain ($V_H$) and a light chain variable domain ($V_L$), wherein the $V_H$ and $V_L$, together form an antigen-binding site that specifically binds a second epitope (e.g., PD-1, PD-L1), wherein the first antigen binding portion and the second antigen binding portion are fused to each other. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized. In some embodiments, the second epitope is an immune checkpoint molecule (e.g., PD-1, PD-L1). In some embodiments, the second epitope is a pro-inflammatory molecule. In some embodiments, the second epitope is a cell surface antigen (such as tumor antigen, or a cell surface antigen on an immune effector cell). In some embodiments, the second antigen binding portion comprises a heavy chain comprising the $V_H$ and a light chain comprising the $V_L$. In some embodiments, the first antigen binding portion is fused to the second antigen binding portion at the N-terminus of the heavy chain, the N-terminus of the light chain, the N-terminus of the Fc region, the C-terminus of the heavy chain, or the C-terminus of the light chain. In some embodiments, the second antigen binding portion comprises a full-length 4-chain antibody. In some embodiments, the second antigen binding portion comprises an anti-PD-1 full-length antibody. In some embodiments, the full-length antibody comprises a heavy chain comprising the amino acid sequence of SEQ ID NO: 158, and a light chain comprising the amino acid sequence of SEQ ID NO: 159. In some embodiments, the full-length antibody comprises a heavy chain comprising the amino acid sequence of SEQ ID NO: 160, and a light chain comprising the amino acid sequence of SEQ ID NO: 161. In some embodiments, the full-length antibody comprises a heavy chain comprising the amino acid sequence of SEQ ID NO: 308, and a light chain comprising the amino acid sequence of SEQ ID NO: 309. In some embodiments, the second antigen binding portion comprises an anti-PD-L1 full-length antibody. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the first antigen binding portion is fused to the second antigen binding portion chemically. In some embodiments, the first antigen binding portion is fused to the second antigen binding portion via a peptide linker. In some embodiments, the peptide linker is no more than about 30 (such as no more than about any one of 25, 20, or 15) amino acids long. In some embodiments, the peptide linker comprises the amino acid sequence of SEQ ID NO: 162, 163, 307, or 365. In some embodiments, the second antigen binding fragment comprises an Fc region, such as an IgG1 Fc or IgG4 Fc.

In some embodiments, the anti-CTLA-4 construct (e.g., MABP or BABP) comprises at least two antigen binding portions that can specifically bind at least two different epitopes. Some of the at least two antigen binding portions may be identical, so long as the MABP has binding sites for two different epitopes. The anti-CTLA-4 MABPs can be symmetric or asymmetric. For example, the anti-CTLA-4 MABP may comprise one to eight copies of the first antigen binding portion comprising anti-CTLA-4 sdAb, and one or two copies of the second antigen binding portion. In some embodiments, the anti-CTLA-4 MABP comprises two different antigen binding portions that each comprise a $V_H$ domain and a $V_L$ domain that together form a different antigen binding site. For example, the second antigen binding portion can be a bispecific antibody. In some embodiments, the second antigen binding portion is a monospecific full-length antibody or antigen binding fragment thereof, such as a Fab or scFv.

In some embodiments, the anti-CTLA-4 MABP comprises any one of 1, 2, 3, 4, 5, 6, 7, 8, or more different antigen binding portions that each comprises an anti-CTLA-4 sdAb described herein. In some embodiments, two identical anti-CTLA-4 sdAbs are fused to each other, which is further fused to the second antigen binding portion. In some embodiments, two different anti-CTLA-4 sdAbs are fused to each other, which is further fused to the second antigen binding portion.

The anti-CTLA-4 constructs (e.g. MABPs) may have any suitable number of valencies for CTLA-4 and/or the second epitope (e.g., PD-1, PD-L1), and any suitable number of specificity. In some embodiments, the MABP is bivalent, trivalent, tetravalent, pentavalent, hexavalent, or of higher valencies for CTLA-4. In some embodiments, the MABP is bivalent, trivalent, tetravalent, pentavalent, hexavalent, or of higher valencies for the second epitope (e.g., PD-1, PD-L1). In some embodiments, the MABP is bispecific (e.g., CTLA-4×PD-1 BABP, CTLA-4×PD-L1 BABP). Exemplary BABPs are depicted in FIGS. 40-49. In some embodiments, the MABP is trispecific. In some embodiments, the MABP is tetraspecific. In some embodiments, the MABP has more than four specificities.

In some embodiments, there is provided an anti-CTLA-4 bispecific antigen binding protein ("BABP") comprising: (a) one or more copies (such as 2) of a first antigen binding portion comprising an anti-CTLA-4 sdAb comprising a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and (b) a single copy of a second antigen binding portion comprising a heavy chain variable domain ($V_H$) and a light chain variable domain ($V_L$), wherein the $V_H$ and $V_L$, together form an antigen-binding site that specifically binds a second epitope (e.g., PD-1, PD-L1), wherein each copy of the first antigen binding portion is fused to the second antigen binding portion. In some embodiments, the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H$H domain comprising the amino acid sequence of any one of SEQ ID NOs: 113-129, 200-202, 274-282, 341-344, 352, and 353. In some embodiments, one or more of the anti-CTLA-4 sdAb is each further fused to another identical or different anti-CTLA-4 sdAb. In some embodiments, the second antigen binding portion comprises an anti-PD-1 full-length antibody. In some embodiments, the full-length antibody comprises a heavy chain comprising the amino acid sequence of SEQ ID NO: 158, and a light chain comprising the amino acid sequence of SEQ ID NO: 159. In some embodiments, the full-length antibody comprises a heavy chain comprising the amino acid sequence of SEQ ID NO: 160, and a light chain comprising the amino acid sequence of SEQ ID NO: 161. In some embodiments, the full-length antibody comprises a heavy chain comprising the amino acid sequence of SEQ ID NO: 308, and a light chain comprising the amino acid sequence of SEQ ID NO: 309. In some embodiments, the second antigen binding portion comprises an anti-PD-L1 full-length antibody. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the first antigen binding portion is fused to the second antigen binding portion via a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized. In some embodiments, the second antigen binding fragment comprises an Fc region, such as an IgG1 Fc or IgG4 Fc.

In some embodiments, there is provided an anti-CTLA-4 MABP comprising: (a) a plurality (such as 2, 3, 4, 5, 6, 7, 8, or more) of identical or different anti-CTLA-4 sdAbs comprising a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and (b) a plurality (such as 2, 3, 4, 5, 6, or more) of a second antigen binding portion comprising a heavy chain variable domain ($V_H$) and a light chain variable domain ($V_L$), wherein the $V_H$ and $V_L$, together form an antigen-binding site that specifically binds a second epitope (e.g., PD-1, PD-L1), and, wherein the anti-CTLA-4 sdAbs are fused to each other, and/or to the second antigen binding portion. In some embodiments, the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H H$ domain comprising the amino acid sequence of any one of SEQ ID NOs: 113-129, 200-202, 274-282, 341-344, 352, and 353. In some embodiments, the second antigen binding portion comprises an anti-PD-1 full-length antibody. In some embodiments, the full-length antibody comprises a heavy chain comprising the amino acid sequence of SEQ ID NO: 158, and a light chain comprising the amino acid sequence of SEQ ID NO: 159. In some embodiments, the full-length antibody comprises a heavy chain comprising the amino acid sequence of SEQ ID NO: 160, and a light chain comprising the amino acid sequence of SEQ ID NO: 161. In some embodiments, the full-length antibody comprises a heavy chain comprising the amino acid sequence of SEQ ID NO: 308, and a light chain comprising the amino acid sequence of SEQ ID NO: 309. In some embodiments, the second antigen binding portion comprises an anti-PD-L1 full-length antibody. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the first antigen binding portion is fused to the second antigen binding portion via a peptide linker. In some embodiments, the anti-CTLA-4 sdAbs are fused to each other via a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized. In some embodiments, the second antigen binding fragment comprises an Fc region, such as an IgG1 Fc or IgG4 Fc.

In some embodiments, there is provided an anti-CTLA-4 multispecific (such as bispecific) antigen binding protein comprising: (a) a single copy of a first antigen binding portion comprising an anti-CTLA-4 sdAb comprising a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and (b) two copies of a second antigen binding portion each comprising a heavy chain variable domain ($V_H$) and a light chain variable domain ($V_L$), wherein the $V_H$ and $V_L$, together form an antigen-binding site that specifically binds a second epitope (e.g., PD-1, PD-L1), wherein the first antigen binding portion is fused to one of the two copies of the second antigen binding portion. In some embodiments, the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H H$ domain comprising the amino acid sequence of any one of SEQ ID NOs: 113-129, 200-202, 274-282, 341-344, 352, and 353. In some embodiments, the second antigen binding portion comprises an anti-PD-1 full-length antibody. In some embodiments, the full-length antibody comprises a heavy chain comprising the amino acid sequence of SEQ ID NO: 158, and a light chain comprising the amino acid sequence of SEQ ID NO: 159. In some embodiments, the full-length antibody comprises a heavy chain comprising the amino acid sequence of SEQ ID NO: 160, and a light chain comprising the amino acid sequence of SEQ ID NO: 161. In some embodiments, the full-length antibody comprises a heavy chain comprising the amino acid sequence of SEQ ID NO: 308, and a light chain comprising the amino acid sequence of SEQ ID NO: 309. In some embodiments, the second antigen binding portion comprises an anti-PD-L1 full-length antibody. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the first antigen binding portion is fused to the second antigen binding portion via a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized. In some embodiments, the second antigen binding fragment comprises an Fc region, such as an IgG1 Fc or IgG4 Fc. Examples are shown in FIGS. 44, 45, 48, and 49.

In some embodiments, there is provided an anti-CTLA-4 multispecific (such as bispecific) antigen binding protein comprising: (a) two copies of a first antigen binding portion each comprising an anti-CTLA-4 sdAb comprising a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, (b) two copies of a second antigen binding portion each comprising a heavy chain variable domain ($V_H$) and a light chain variable domain ($V_L$), wherein the $V_H$ and $V_L$, together form an antigen-binding site that specifically binds a second epitope (e.g., PD-1, PD-L1), wherein one copy of the first antigen binding portion is fused to each copy of the second antigen binding portion. In some embodiments, one or more of the anti-CTLA-4 sdAbs is each further fused to another identical or different anti-CTLA-4 sdAb. In some embodiments, the anti-CTLA-4 sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H$H domain comprising the amino acid sequence of any one of SEQ ID NOs: 113-129, 200-202, 274-282, 341-344, 352, and 353. In some embodiments, the second antigen binding portion comprises an anti-PD-1 full-length antibody. In some embodiments, the full-length antibody comprises a heavy chain comprising the amino acid sequence of SEQ ID NO: 158, and a light chain comprising the amino acid sequence of SEQ ID NO: 159. In some embodiments, the full-length antibody comprises a heavy chain comprising the amino acid sequence of SEQ ID NO: 160, and a light chain comprising the amino acid sequence of SEQ ID NO: 161. In some embodiments, the full-length antibody comprises a heavy chain comprising the amino acid sequence of SEQ ID NO: 308, and a light chain comprising the amino acid sequence of SEQ ID NO: 309. In some embodiments, the second antigen binding portion comprises an anti-PD-L1 full-length antibody. In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the first antigen binding portion is fused to the second antigen binding portion via a peptide linker. In some embodiments, the peptide linker comprises the amino acid sequence of SEQ ID NO: 162, 163, 307, or 365. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized. In some embodiments, the second antigen binding fragment comprises an Fc region, such as an IgG1 Fc or IgG4 Fc. Examples are shown in FIGS. 40-43, 46, and 47.

a) Fusion Polypeptides

The first antigen binding portion and the second antigen binding portion of the anti-CTLA-4 MABP are fused (i.e., covalently linked) to each other. Thus, the anti-CTLA-4 MABPs of the present application comprise one or more fusion polypeptides. Each fusion polypeptide may comprise the first antigen binding portion comprising anti-CTLA-4 sdAb described herein, and a polypeptide from the second antigen binding portion.

The first antigen binding portion comprising anti-CTLA-4 sdAb and the second antigen binding portion may be linked directly by a single chemical bond (such as peptide bond) or via a peptide linker. The first antigen binding portion comprising anti-CTLA-4 sdAb may be fused at either the N-terminus or the C-terminus of any one (including each) polypeptide of the second antigen binding portion, or may be fused at an internal position of any one (including each) polypeptide of the second antigen binding portion, such as at the N-terminus of the Fc region in the heavy chain of the second antigen binding portion. The fusion polypeptides may be obtained either recombinantly or chemically. In some embodiments, the C-terminus of the first antigen binding portion comprising anti-CTLA-4 sdAb is fused to the N-terminus of any (including each) polypeptide of the second antigen binding portion via a chemical bond (such as peptide bond) or a peptide linker. In some embodiments, the N-terminus of the first antigen binding portion comprising anti-CTLA-4 sdAb is fused to the C-terminus of any (including each) polypeptide of the second antigen binding portion via a chemical bond (such as peptide bond) or a peptide linker. In some embodiments, the first antigen binding portion comprising anti-CTLA-4 sdAb is fused to the second antigen binding portion via a chemical bond that is not a peptide bond involving the main chain chemical groups of amino acids.

In some embodiments, the second antigen binding portion comprises a single-chain antibody fragment comprising the $V_H$ and $V_L$. In some embodiments, the second antigen binding portion comprises an scFv. In some embodiments, the anti-CTLA-4 MABP comprises a fusion polypeptide comprising in the N-terminus to C-terminus direction: the first antigen binding portion comprising the anti-CTLA-4 sdAb described herein, an optional peptide linker, the $V_H$ domain and the $V_L$ domain. In some embodiments, the anti-CTLA-4 MABP comprises a fusion polypeptide comprising in the N-terminus to C-terminus direction: the first antigen binding portion comprising the anti-CTLA-4 sdAb described herein, an optional peptide linker, the $V_L$ domain and the $V_H$ domain. In some embodiments, the anti-CTLA-4 MABP comprises a fusion polypeptide comprising in the N-terminus to C-terminus direction: the $V_H$ domain, the $V_L$ domain, an optional peptide linker, and the first antigen binding portion comprising the anti-CTLA-4 sdAb described herein. In some embodiments, anti-CTLA-4 the MABP comprises a fusion polypeptide comprising in the N-terminus to C-terminus direction: the $V_L$ domain, the $V_H$ domain, an optional peptide linker, and the first antigen binding portion comprising the anti-CTLA-4 sdAb described herein.

In some embodiments, the second antigen binding portion comprises a heavy chain comprising the $V_H$ domain, and a light chain comprising the $V_L$ domain. In some embodiments, the heavy chain further comprises one or more heavy chain constant domains, such as $C_H1$, $C_H2$, $C_H3$, and $C_H4$, and/or an antibody hinge region (HR). In some embodiments, the light chain further comprises a light chain constant domain ($C_L$), such as the lambda $C_L$ domain or kappa $C_L$ domain. In some embodiments, the N-terminus of the first antigen binding portion comprising anti-CTLA-4 sdAb described herein is fused to the C-terminus of the heavy chain. In some embodiments, the C-terminus of the first antigen binding portion comprising anti-CTLA-4 sdAb described herein is fused to the N-terminus of the heavy chain. In some embodiments, the N-terminus of the first antigen binding portion comprising anti-CTLA-4 sdAb described herein is fused to the C-terminus of the light chain. In some embodiments, the C-terminus of the first antigen binding portion comprising anti-CTLA-4 sdAb described herein is fused to the N-terminus of the light chain. In some embodiments, the anti-CTLA-4 MABP comprises a first polypeptide comprising from the N-terminus to the C-terminus: the heavy chain, an optional peptide linker, and the first antigen binding portion comprising the anti-CTLA-4 sdAb described herein; and a second polypeptide comprising the light chain. In some embodiments, the anti-CTLA-4 MABP comprises a first polypeptide comprising from the N-terminus to the C-terminus: the first antigen binding portion comprising the anti-CTLA-4 sdAb described herein, an optional peptide linker, and the heavy chain; and a second polypeptide comprising the light chain. In some embodiments, the anti-CTLA-4 MABP comprises a first polypeptide comprising from the N-terminus to the C-terminus: the light chain, an optional peptide linker, and the first antigen binding portion comprising the anti-CTLA-4 sdAb described herein; and a second polypeptide comprising the heavy chain. In some embodiments, the anti-CTLA-4 MABP comprises a first polypeptide comprising from the N-terminus to the C-terminus: the first antigen binding portion comprising the anti-CTLA-4 sdAb described herein, an optional peptide linker, and the light chain; and a second polypeptide comprising the heavy chain.

In some embodiments, the second antigen binding portion comprises a full-length antibody consisting of two heavy chains and two light chains (e.g., anti-PD-1 or anti-PD-L1 full-length antibody). In some embodiments, the full-length antibody is a full-length monoclonal antibody consisting of two identical heavy chains and two identical light chains. In some embodiments, the anti-CTLA-4 MABP comprises two identical first polypeptides each comprising from the N-terminus to the C-terminus: the heavy chain, an optional peptide linker, and the first antigen binding portion comprising the anti-CTLA-4 sdAb described herein; and two second polypeptides each comprising the light chain (see, for example, FIG. 41). In some embodiments, the anti-CTLA-4 MABP comprises two identical first polypeptides each comprising from the N-terminus to the C-terminus: the first antigen binding portion comprising the anti-CTLA-4 sdAb described herein, an optional peptide linker, and the heavy chain; and two identical second polypeptides each comprising the light chain (see, for example, FIG. 40). In some embodiments, the anti-CTLA-4 MABP comprises two identical first polypeptides each comprising from the N-terminus to the C-terminus: the light chain, an optional peptide linker, and the first antigen binding portion comprising the anti-CTLA-4 sdAb described herein; and two identical second polypeptides each comprising the heavy chain (see, for example, FIG. 43). In some embodiments, the anti-CTLA-4 MABP comprises two identical first polypeptides each comprising from the N-terminus to the C-terminus: the first antigen binding portion comprising the anti-CTLA-4 sdAb described herein, an optional peptide linker, and the light chain; and two identical second polypeptides comprising the heavy chain (see, for example, FIG. 42).

In some embodiments, the anti-CTLA-4 MABP comprises: (a) a full-length antibody consisting of a first and a second heavy chains and a first and a second light chains, wherein the full-length antibody specifically recognizes a first epitope (e.g., PD-1, PD-L1); (b) a first anti-CTLA-4 sdAb described herein that specifically recognizes a second epitope; (c) a second anti-CTLA-4 sdAb described herein that specifically recognizes a third epitope; (d) a third anti-CTLA-4 sdAb described herein that specifically recognizes a fourth epitope; and (e) a fourth anti-CTLA-4 sdAb described herein that specifically recognizes a fifth epitope; wherein the C-terminus of the first anti-CTLA-4 sdAb is fused to the N-terminus of the first light chain, wherein the C-terminus of the second anti-CTLA-4 sdAb is fused to the N-terminus of the second light chain, wherein the C-terminus of the third anti-CTLA-4 sdAb is fused to the N-terminus of the first heavy chain, and wherein the C-terminus of the fourth anti-CTLA-4 sdAb is fused to the N-terminus of the second heavy chain. In some embodiments, the four anti-CTLA-4 sdAbs are different. In some embodiments, the four anti-CTLA-4 sdAbs are identical. In some embodiments, the anti-CTLA-4 MABP comprises two identical first polypeptides each comprising from the N-terminus to the C-terminus: the third or the fourth anti-CTLA-4 sdAb, an optional peptide linker, and the heavy chain; and two identical second polypeptides each comprising the first or the second anti-CTLA-4 sdAb, an optional peptide linker, and the light chain. See, for example, FIG. 44.

In some embodiments, the anti-CTLA-4 MABP comprises: (a) a full-length antibody consisting of two heavy chains and two light chains, wherein the full-length antibody specifically recognizes a first epitope (e.g., PD-1, PD-L1); (b) a first anti-CTLA-4 sdAb described herein that specifically recognizes a second epitope; (c) a second anti-CTLA-4 sdAb described herein that specifically recognizes a third epitope; (d) a third anti-CTLA-4 sdAb described herein that specifically recognizes a fourth epitope; and (e) a fourth anti-CTLA-4 sdAb described herein that specifically recognizes a fifth epitope; wherein the C-terminus of the first anti-CTLA-4 sdAb is fused to the N-terminus of the second anti-CTLA-4 sdAb, and the C-terminus of the second anti-CTLA-4 sdAb is fused to the N-terminus of one heavy chain, and wherein the C-terminus of the third anti-CTLA-4 sdAb is fused to the N-terminus of the fourth anti-CTLA-4 sdAb, and the C-terminus of the fourth anti-CTLA-4 sdAb is fused to the N-terminus of the other heavy chain. In some embodiments, the four anti-CTLA-4 sdAbs are different. In some embodiments, the four anti-CTLA-4 sdAbs are identical. In some embodiments, the anti-CTLA-4 MABP comprises two identical first polypeptides each comprising from the N-terminus to the C-terminus: the first or the third anti-CTLA-4 sdAb, an optional peptide linker, the second or the fourth anti-CTLA-4 sdAb, an optional peptide linker, and the heavy chain; and two identical second polypeptides each comprising the light chain. See, for example, FIG. 45.

In some embodiments, the anti-CTLA-4 MABP comprises: (a) a full-length antibody consisting of two heavy chains and two light chains, wherein the full-length antibody specifically recognizes a first epitope (e.g., PD-1, PD-L1); (b) a first anti-CTLA-4 sdAb described herein that specifically recognizes a second epitope; and (c) a second anti-CTLA-4 sdAb described herein that specifically recognizes a third epitope, wherein the N-terminus of the first or the second anti-CTLA-4 sdAb is fused to the C-terminus of the $C_H1$ region of the heavy chain, and the C-terminus of the first or the second anti-CTLA-4 sdAb is fused to the N-terminus of the $C_H2$ region of the heavy chain. In some embodiments, the two anti-CTLA-4 sdAbs are identical. In some embodiments, the two anti-CTLA-4 sdAbs are different. In some embodiments, the anti-CTLA-4 MABP comprises two identical first polypeptides each comprising from the N-terminus to the C-terminus: $V_H$-$C_H1$-an optional peptide linker-anti-CTLA-4 sdAb-$C_H2$-$C_H3$; and two identical second polypeptides each comprising the light chain. See, for example, FIG. 46.

In some embodiments, the anti-CTLA-4 MABP comprises: (a) a first scFv that specifically recognizes a first epitope (e.g., PD-1, PD-L1); (b) a second scFv that specifically recognizes a second epitope (e.g., PD-1, PD-L1); (c) an Fc region; (d) a first anti-CTLA-4 sdAb described herein that specifically recognizes a third epitope; and (d) a second anti-CTLA-4 sdAb described herein that specifically recognizes a fourth epitope, wherein the N-terminus of each anti-CTLA-4 sdAb is fused to the C-terminus of an scFv and the C-terminus of the anti-CTLA-4 sdAb is fused to the N-terminus of the Fc region. In some embodiments, the two anti-CTLA-4 sdAbs are identical. In some embodiments, the two anti-CTLA-4 sdAbs are different. In some embodiments, the two scFvs are identical. In some embodiments, the two scFvs are different. In some embodiments, the anti-CTLA-4 MABP comprises two identical polypeptides each comprising from the N-terminus to the C-terminus: scFv-an optional peptide linker-anti-CTLA-4 sdAb-$CH_2$—$CH_3$. See, for example, FIG. 47.

In some embodiments, the anti-CTLA-4 MABP comprises: (a) a first Fab that specifically recognizes a first epitope (e.g., PD-1, PD-L1): (b) a second Fab that specifically recognizes a second epitope (e.g., PD-1, PD-L1); (c) an Fc region; (d) a first Fab-like domain comprising a first anti-CTLA-4 sdAb described herein that specifically recognizes a third epitope and a second anti-CTLA-4 sdAb described herein that specifically recognizes a fourth epitope; (e) a second Fab-like domain comprising a third anti-CTLA-4 sdAb described herein that specifically recognizes a fifth epitope and a fourth anti-CTLA-4 sdAb described herein that specifically recognizes a sixth epitope, wherein the N-termini of each Fab-like domain are fused to the C-termini of a Fab and one of the two C-termini of the Fab-like domain is fused to the N-terminus of the Fc region. In some embodiments, the four anti-CTLA-4 sdAbs are identical. In some embodiments, the four anti-CTLA-4 sdAbs are different. In some embodiments, the two Fabs are identical. In some embodiments, the two Fabs are different. In some embodiments, the anti-CTLA-4 MABP comprises two identical first polypeptides each comprising from the N-terminus to the C-terminus: $V_H$-$C_H$1-an optional peptide linker-anti-CTLA-4 sdAb-$C_H$1-$C_H$2-$C_H$3; and two identical second polypeptides each comprising from the N-terminus to the C-terminus: $V_L$-$C_L$-an optional peptide linker-anti-CTLA-4 sdAb-$C_L$. See, for example, FIG. 48.

In some embodiments, the anti-CTLA-4 MABP comprises: (a) a first scFv that specifically recognizes a first epitope (e.g., PD-1, PD-L1); (b) a second scFv that specifically recognizes a second epitope 9 e.g., PD-1, PD-L1); (c) an Fc region; (d) a first Fab-like domain comprising a first anti-CTLA-4 sdAb described herein that specifically recognizes a third epitope and a second anti-CTLA-4 sdAb described herein that specifically recognizes a fourth epitope; (e) a second Fab-like domain comprising a third anti-CTLA-4 sdAb described herein that specifically recognizes a fifth epitope and a fourth anti-CTLA-4 sdAb described herein that specifically recognizes a sixth epitope, wherein one of the two N-termini of each Fab-like domain is fused to the C-terminus of an scFv and one of the two C-termini of the Fab-like domain is fused to the N-terminus of the Fc region. In some embodiments, the four anti-CTLA-4 sdAbs are identical. In some embodiments, the four anti-CTLA-4 sdAbs are different. In some embodiments, the two scFvs are identical. In some embodiments, the two scFvs are different. In some embodiments, the anti-CTLA-4 MABP comprises two identical first polypeptides each comprising from the N-terminus to the C-terminus: scFv-an optional peptide linker-anti-CTLA-4 sdAb-$C_H$1-$C_H$2-$C_H$3; and two identical second polypeptides each comprising from the N-terminus to the C-terminus: anti-CTLA-4 sdAb-$C_L$. See, for example, FIG. 49.

The anti-CTLA-4 MABPs described herein may comprise one or more peptide linkers situated between the first antigen binding portion and the second antigen binding portion. In some embodiments, the peptide linker between the heavy chain polypeptide of the second antigen binding portion and the first antigen binding portion is the same as the peptide linker between the light chain polypeptide of the second antigen binding portion and the first antigen binding portion. In some embodiments, the peptide linker between the heavy chain polypeptide of the second antigen binding portion and the first antigen binding portion is different from the peptide linker between the light chain polypeptide of the second antigen binding portion and the first antigen binding portion. In some embodiments, the first antigen binding portion and the second antigen binding portion are directly fused to each other without a peptide linker disposed therebetween. The peptide linker between the two or more anti-CTLA-4 sdAbs may be the same as or different from that between the anti-CTLA-4 sdAb and the second antigen binding portion. Any of the peptide linkers described above in the "Peptide linkers" section can be employed in any of the anti-CTLA-4 MABPs described herein.

b) Second Antigen Binding Portion Comprising $V_H$ and $V_L$

The anti-CTLA-4 MABPs (e.g., BABPs) comprise at least one antigen binding portion comprising a heavy chain variable domain ($V_H$) and a light chain variable domain ($V_L$). Such antigen binding portion can be a full-length conventional antibody consisting of two heavy chains and two light chains, or an antigen binding fragment derived therefrom.

In some embodiments, the second antigen binding portion is an antigen binding fragment comprising a heavy chain comprising the $V_H$ domain and a light chain comprising the $V_L$ domain. Exemplary antigen binding fragments contemplated herein include, but are not limited to, Fab, Fab', F(ab')$_2$, and Fv fragments; diabodies; linear antibodies; single-chain antibody molecules (such as scFv); and multispecific antibodies formed from antibody fragments.

In some embodiments, the second antigen binding portion comprises an Fc region, such as a human Fc region. In some embodiments, the Fc region is derived from an IgG molecule, such as any one of the IgG1, IgG2, IgG3, or IgG4 subclass. In some embodiments, the Fc region is capable of mediating an antibody effector function, such as ADCC (antibody-dependent cell-mediated cytotoxicity) and/or CDC (complement-dependent cytotoxicity). For example, antibodies of subclass IgG1, IgG2, and IgG3 with wildtype Fc sequences usually show complement activation including C1q and C3 binding, whereas IgG4 does not activate the complement system and does not bind C1q and/or C3. In some embodiments, the Fc region comprises a modification that reduces binding affinity of the Fc region to an Fc receptor. In some embodiments, the Fc region is an IgG1 Fc. In some embodiments, the IgG1 Fc comprises one or mutations in positions 233-236, such as L234A and/or L235A. In some embodiments, the Fc region is an IgG4 Fc. In some embodiments, the IgG4 Fc comprises a mutation in positions 327, 330 and/or 331. See, for example, Armour K L et al., *Eur J. Immunol.* 1999; 29: 2613; and Shields R L et al., *J. Biol. Chem.* 2001; 276: 6591. In some embodiments, the Fc region comprises a P329G mutation.

In some embodiments, the Fc region comprises a modification that promotes heterodimerization of two non-identical heavy chains. Such modified Fc regions may be of particular interest for anti-CTLA-4 MABPs described herein having an asymmetric design. In some embodiments, said modification is a knob-into-hole modification, comprising a knob modification in one of the heavy chains or heavy chain fusion polypeptides and a hole modification in the other one of the two heavy chains or heavy chain fusion polypeptides. In one embodiment, the Fc region comprises a modification within the interface between the two heavy chains in the CH3 domain, wherein i) in the CH3 domain of one heavy chain, an amino acid residue is replaced with an amino acid residue having a larger side chain volume, thereby generating a protuberance ("knob") within the interface in the CH3 domain of one heavy chain which is positionable in a cavity ("hole") within the interface in the CH3 domain of the other heavy chain, and ii) in the CH3 domain of the other heavy chain, an amino acid residue is replaced with an amino acid residue having a smaller side chain volume, thereby generating a cavity ("hole") within the interface in the second CH3 domain within which a protuberance ("knob") within the interface in the first CH3 domain is positionable. Examples of knob-into-hole modifications have been described, for example, in US 2011/0287009, US2007/0178552, WO 96/027011, WO 98/050431, and Zhu et al., 1997, *Protein Science* 6:781-788. Other modifications to the Fc region that promote heterodimerization are also contemplated herein. For example, electrostatic steering effects can be engineered into the Fc region to provide Fc-heterodimeric molecules (see, e.g., U.S. Pat. No. 4,676,980, and Brennan et al., *Science,* 229: 81 (1985)).

In some embodiments, the Fc region comprises a modification that inhibits Fab arm exchange. For example, the S228P mutation in IgG4 Fc prevents Fab arm exchange.

In some embodiments, the second antigen binding portion comprises a kappa light chain constant region. In some embodiments, the second antigen binding portion comprises a lambda light chain constant region. In some embodiments, the second antigen binding portion comprises a heavy chain constant region.

In some embodiments, the second antigen binding portion is a full-length antibody consisting of two heavy chains and two light chains. In some embodiments, the second antigen binding portion comprises a monoclonal antibody consisting of two heavy chains and two light chains (also referred herein as "4-chain antibody"). In some embodiments, the second antigen binding portion comprises a multispecific (such as bispecific) full-length antibody consisting of two heavy chains and two light chains. In some embodiments, the second antigen binding portion comprises a full-length antibody of human IgG1 subclass, or of human IgG1 subclass with the mutations L234A and L235A. In some embodiments, the second antigen binding portion comprises a full-length antibody of human IgG2 subclass. In some embodiments, the second antigen binding portion comprises a full-length antibody of human IgG3 subclass. In some embodiments, the second antigen binding portion comprises a full-length antibody of human IgG4 subclass or, of human IgG4 subclass with the additional mutation S228P.

Any full-length 4-chain antibody known in the art or antigen binding fragments derived therefrom can be used as the second antigen binding portion in the anti-CTLA-4 MABP. Antibodies or antibody fragments with proven clinical efficacy, safety, and pharmacokinetics profile are of particular interest. In some embodiments, the antibody or antibody fragment known in the art is further engineered, such as humanized or mutagenized to select for a variant with a suitable affinity, prior to fusion with the first antigen binding portion to provide the anti-CTLA-4 MABP. In some embodiments, the second antigen binding portion comprises the $V_H$ and $V_L$ domains of a monoclonal antibody or antibody fragment known in the art, and modified heavy chain constant region and/or light chain constant region. In some embodiments, the second antigen binding portion comprises the monoclonal antibody known in the art and a modified Fc region, such as an IgG4 Fc with an S228P mutation. In some embodiments, the second antigen binding portion comprises a human, humanized, or chimeric full-length antibody or antibody fragments.

In some embodiments, the second antigen binding portion is an anti-PD-1 antibody or antigen binding fragment thereof. In some embodiments, the anti-PD-1 antibody is pembrolizumab (e.g., Keytruda®) or nivolumab (e.g., Opdivo®). In some embodiments, the anti-PD-1 antibody comprises a heavy chain comprising the amino acid sequence of SEQ ID NO: 158, and a light chain comprising the amino acid sequence of SEQ ID NO: 159. In some embodiments, the anti-PD-1 antibody comprises a heavy chain comprising the amino acid sequence of SEQ ID NO: 160, and a light chain comprising the amino acid sequence of SEQ ID NO: 161. In some embodiments, the anti-PD-1 antibody comprises a heavy chain comprising the amino acid sequence of SEQ ID NO: 308, and a light chain comprising the amino acid sequence of SEQ ID NO: 309. In some embodiments, the second antigen binding portion is an anti-PD-L1 antibody or antigen binding fragment thereof. In some embodiments, the anti-PD-L1 antibody is atezolizumab (e.g., Tecentriq®) or durvalumab (e.g., IMFINZI™). In some embodiments, the anti-PD-L1 antibody comprises a heavy chain comprising the amino acid sequence of SEQ ID NO: 195, and a light chain comprising the amino acid sequence of SEQ ID NO: 196. In some embodiments, the anti-PD-L1 antibody comprises a heavy chain comprising the amino acid sequence of SEQ ID NO: 197, and a light chain comprising the amino acid sequence of SEQ ID NO: 198.

c) Exemplary Anti-CTLA-4 MABPs and BABPs

In some embodiments, the anti-CTLA-4 MABP (e.g., BABP) comprises (a) a first antigen binding portion comprising an sdAb specifically recognizing CTLA-4 described herein, and (b) a second antigen binding portion comprising a heavy chain variable domain ($V_H$) and a light chain variable domain ($V_L$), wherein the $V_H$ and $V_L$ together form an antigen-binding site that specifically binds PD-1, wherein the first antigen binding portion and the second antigen binding portion are fused to each other, herein after referred to as "CTLA-4×PD-1 BABP" or "CTLA-4×PD-1 BABP." In some embodiments, the anti-CTLA-4 MABP (e.g., BABP) comprises (a) a first antigen binding portion comprising an sdAb specifically recognizing CTLA-4 described herein, and (b) a second antigen binding portion comprising a heavy chain variable domain ($V_H$) and a light chain variable domain ($V_L$), wherein the $V_H$ and $V_L$ together form an antigen-binding site that specifically binds PD-L1, wherein the first antigen binding portion and the second antigen binding portion are fused to each other, herein after referred to as "CTLA-4×PD-L1 BABP" or "CTLA-4×PD-L1 BABP."

In some embodiments, there is provided an anti-CTLA-4 multispecific (such as bispecific) antigen binding protein comprising: (a) a first antigen binding portion comprising an sdAb specifically recognizing CTLA-4 comprising a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and (b) a second antigen binding portion comprising a full-length antibody (such as pembrolizumab or nivolumab) consisting of two heavy chains and two light chains, wherein the full-length antibody specifically binds PD-1; and wherein the first antigen binding portion and the second antigen binding portion are fused to each other. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_HH$ domain comprising the amino acid sequence of any one of SEQ ID NOs: 113-129, 200-202, 274-282, 341-344, 352, and 353. In some embodiments, the full-length antibody comprises a heavy chain comprising the amino acid sequence of SEQ ID NO: 158, and a light chain comprising the amino acid sequence of SEQ ID NO: 159. In some embodiments, the full-length antibody comprises a heavy chain comprising the amino acid sequence of SEQ ID NO: 160, and a light chain comprising the amino acid sequence of SEQ ID NO: 161. In some embodiments, the full-length antibody comprises a heavy chain comprising the amino acid sequence of SEQ ID NO: 308, and a light chain comprising the amino acid sequence of SEQ ID NO: 309. In some embodiments, the first antigen binding portion is fused to the second antigen binding portion at the N-terminus of one or each of the two heavy chains, the N-terminus of one or each of the two light chains, the N-terminus of the Fc region, the C-terminus of one or each of the two heavy chains, or the C-terminus of one or each of the two light chains. In some embodiments, the first antigen binding portion is fused to the second antigen binding portion chemically. In some embodiments, the first antigen binding portion is fused to the second antigen binding portion via a peptide bond or a peptide linker. In some embodiments, the peptide linker is no more than about 30 (such as no more than about any one of 25, 20, or 15) amino acids long. In some embodiments, the peptide linker comprises the amino acid sequence of SEQ ID NO: 162, 163, 307, or 365. In some embodiments, the second antigen binding fragment comprises an Fc region, such as an IgG4 Fc. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the anti-CTLA-4 sdAb moiety is camelid, chimeric, human, partially humanized, or fully humanized.

In some embodiments, there is provided an anti-CTLA-4 bispecific antigen binding protein (BABP) comprising: (a) a first polypeptide comprising from N-terminus to C-terminus: $V_H$-$C_H$1-$C_H$2-$C_H$3-anti-CTLA-4 sdAb; and (b) a second polypeptide comprising from N-terminus to C-terminus: $V_L$-$C_L$, wherein $V_H$ and $V_L$ forms an antigen binding site that specifically binds PD-1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H$H domain comprising the amino acid sequence of any one of SEQ ID NOs: 113-129, 200-202, 274-282, 341-344, 352, and 353. In some embodiments, the $V_H$ and $V_L$ domains are derived from pembrolizumab or nivolumab. In some embodiments, the $V_H$ and $V_L$ domains are derived from a full-length antibody comprising a heavy chain comprising the amino acid sequence of SEQ ID NO: 158, and a light chain comprising the amino acid sequence of SEQ ID NO: 159. In some embodiments, the $V_H$ and $V_L$ domains are derived from a full-length antibody comprising a heavy chain comprising the amino acid sequence of SEQ ID NO: 160, and a light chain comprising the amino acid sequence of SEQ ID NO: 161. In some embodiments, the $V_H$ and $V_L$ domains are derived from a full-length antibody comprising a heavy chain comprising the amino acid sequence of SEQ ID NO: 308, and a light chain comprising the amino acid sequence of SEQ ID NO: 309. In some embodiments, the $C_H$3 and anti-CTLA-4 sdAb are fused to each other via a peptide linker, such as a peptide linker comprising the amino acid sequence of SEQ ID NO: 162, 163, 307, or 365. In some embodiments, the $C_H$2 and $C_H$3 domains are derived from an IgG4 Fc. In some embodiments, the $C_H$2 and $C_H$3 domains are derived from an IgG1 Fc. In some embodiments, the anti-CTLA-4 BABP comprises (a) two identical copies of a first polypeptide comprising the amino acid sequence of any one of SEQ ID NOs: 134, 136, 138, 140, 142, 144, and 319-323, and (b) two identical copies of a second polypeptide comprising the amino acid sequence of SEQ ID NO: 159. In some embodiments, the anti-CTLA-4 BABP comprises (a) two identical copies of a first polypeptide comprising the amino acid sequence of any one of SEQ ID NOs: 146, 148, 150, 152, 154, 156, and 324-328, and (b) two identical copies of a second polypeptide comprising the amino acid sequence of SEQ ID NO: 161. In some embodiments, the anti-CTLA-4 BABP comprises (a) two identical copies of a first polypeptide comprising the amino acid sequence of any one of SEQ ID NOs: 329-337, and (b) two identical copies of a second polypeptide comprising the amino acid sequence of SEQ ID NO: 309. In some embodiments, the CTLA-4×PD-1 BABP has the structure as shown in FIG. 41.

In some embodiments, there is provided an anti-CTLA-4 bispecific antigen binding protein (BABP) comprising: (a) a first polypeptide comprising from N-terminus to C-terminus: $V_H$-$C_H$1-$C_H$2-$C_H$3-anti-CTLA-4 sdAb; and (b) a second polypeptide comprising from N-terminus to C-terminus: $V_L$-$C_L$, wherein $V_H$ and $V_L$ forms an antigen binding site that specifically binds PD-L1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H$H domain comprising the amino acid sequence of any one of SEQ ID NOs: 113-129, 200-202, 274-282, 341-344, 352, and 353. In some embodiments, the $V_H$ and $V_L$ domains are derived from atezolizumab or durvalumab. In some embodiments, the $V_H$ and $V_L$ domains are derived from a full-length antibody comprising a heavy chain comprising the amino acid sequence of SEQ ID NO: 195, and a light chain comprising the amino acid sequence of SEQ ID NO: 196. In some embodiments, the $V_H$ and $V_L$ domains are derived from a full-length antibody comprising a heavy chain comprising the amino acid sequence of SEQ ID NO: 197, and a light chain comprising the amino acid sequence of SEQ ID NO: 198. In some embodiments, the $C_H$3 and anti-CTLA-4 sdAb are fused to each other via a peptide linker, such as a peptide linker comprising the amino acid sequence of SEQ ID NO: 162, 163, 307, or 365. In some embodiments, the $C_H$2 and $C_H$3 domains are derived from an IgG4 Fc. In some embodiments, the $C_H$2 and $C_H$3 domains are derived from an IgG1 Fc. In some embodiments, the anti-CTLA-4 BABP comprises (a) two identical copies of a first polypeptide comprising the amino acid sequence of any one of SEQ ID NOs: 171, 173, 175, 177, 179, 181, and 345-349, and (b) two identical copies of a second polypeptide comprising the amino acid sequence of SEQ ID NO: 196. In some embodiments, the anti-CTLA-4 BABP comprises (a) two identical copies of a first polypeptide comprising the amino acid sequence of any one of SEQ ID NOs: 183, 185, 187, 189, 191, and 193, and (b) two identical copies of a second polypeptide comprising the amino acid sequence of SEQ ID NO: 198. In some embodiments, the CTLA-4×PD-L1 BABP has the structure as shown in FIG. 41.

In some embodiments, there is provided an anti-CTLA-4 BABP comprising: (a) a first polypeptide comprising from N-terminus to C-terminus: anti-CTLA-4 sdAb-$V_H$-$C_H$1-$C_H$2-$C_H$3; and (b) a second polypeptide comprising from N-terminus to C-terminus: $V_L$-$C_L$, wherein $V_H$ and $V_L$ forms an antigen binding site that specifically binds PD-1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H$H domain comprising the amino acid sequence of any one of SEQ ID NOs: 113-129, 200-202, 274-282, 341-344, 352, and 353. In some embodiments, the $V_H$ and $V_L$ domains are derived from pembrolizumab or nivolumab. In some embodiments, the $V_H$ and $V_L$ domains are derived from a full-length antibody comprising a heavy chain comprising the amino acid sequence of SEQ ID NO: 158, and a light chain comprising the amino acid sequence of SEQ ID NO: 159. In some embodiments, the $V_H$ and $V_L$ domains are derived from a full-length antibody comprising a heavy chain comprising the amino acid sequence of SEQ ID NO: 160, and a light chain comprising the amino acid sequence of SEQ ID NO: 161. In some embodiments, the $V_H$ and $V_L$ domains are derived from a full-length antibody comprising a heavy chain comprising the amino acid sequence of SEQ ID NO: 308, and a light chain comprising the amino acid sequence of SEQ ID NO: 309. In some embodiments, the $V_H$ and anti-CTLA-4 sdAb are fused to each other via a peptide linker, such as a peptide linker comprising the amino acid sequence of SEQ ID NO: 162, 163, 307, or 365. In some embodiments, the $C_H$2 and $C_H$3 domains are derived from an IgG4 Fc. In some embodiments, the $C_H$2 and $C_H$3 domains are derived from an IgG1 Fc. In some embodiments, the anti-CTLA-4 BABP comprises (a) two identical copies of a first polypeptide comprising the amino acid sequence of any one of SEQ ID NOs: 135, 137, 139, 141, 143, 145, and 292-296, and (b) two identical copies of a second polypeptide comprising the amino acid sequence of SEQ ID NO: 159. In some embodiments, the anti-CTLA-4 BABP comprises (a) two identical copies of a first polypeptide comprising the amino acid sequence of any one of SEQ ID NOs: 147, 149, 151, 153, 155, 157, and 297-301, and (b) two identical copies of a second polypeptide comprising the amino acid sequence of SEQ ID NO: 161. In some embodiments, the anti-CTLA-4 BABP comprises (a) two identical copies of a first polypeptide comprising the amino acid sequence of any one of SEQ ID NOs: 310-318, and (b) two identical copies of a second polypeptide comprising the amino acid sequence of SEQ ID NO: 309. In some embodiments, the CTLA-4×PD-1 BABP has the structure as shown in FIG. 40.

In some embodiments, there is provided an anti-CTLA-4 BABP comprising: (a) a first polypeptide comprising from N-terminus to C-terminus: anti-CTLA-4 sdAb-$V_H$-$C_H$1-$C_H$2-$C_H$3; and (b) a second polypeptide comprising from N-terminus to C-terminus: $V_L$-$C_L$, wherein $V_H$ and $V_L$ forms an antigen binding site that specifically binds PD-L1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H$H domain comprising the amino acid sequence of any one of SEQ ID NOs: 113-129, 200-202, 274-282, 341-344, 352, and 353. In some embodiments, the $V_H$ and $V_L$ domains are derived from atezolizumab or durvalumab. In some embodiments, the $V_H$ and $V_L$ domains are derived from a full-length antibody comprising a heavy chain comprising the amino acid sequence of SEQ ID NO: 195, and a light chain comprising the amino acid sequence of SEQ ID NO: 196. In some embodiments, the $V_H$ and $V_L$ domains are derived from a full-length antibody comprising a heavy chain comprising the amino acid sequence of SEQ ID NO: 197, and a light chain comprising the amino acid sequence of SEQ ID NO: 198. In some embodiments, the $V_H$ and anti-CTLA-4 sdAb are fused to each other via a peptide linker, such as a peptide linker comprising the amino acid sequence of SEQ ID NO: 162, 163, 307, or 365. In some embodiments, the $C_H$2 and $C_H$3 domains are derived from an IgG4 Fc. In some embodiments, the $C_H$2 and $C_H$3 domains are derived from an IgG1 Fc. In some embodiments, the anti-CTLA-4 BABP comprises (a) two identical copies of a first polypeptide comprising the amino acid sequence of any one of SEQ ID NOs: 172, 174, 176, 178, 180, 182, and 302-306, and (b) two identical copies of a second polypeptide comprising the amino acid sequence of SEQ ID NO: 196. In some embodiments, the anti-CTLA-4 BABP comprises (a) two identical copies of a first polypeptide comprising the amino acid sequence of any one of SEQ ID NOs: 184, 186, 188, 190, 192, and 194, and (b) two identical copies of a second polypeptide comprising the amino acid sequence of SEQ ID NO: 198. In some embodiments, the CTLA-4×PD-L1 BABP has the structure as shown in FIG. 40.

In some embodiments, there is provided an anti-CTLA-4 BABP comprising: (a) a first polypeptide comprising from N-terminus to C-terminus: $V_H$-$C_H1$-$C_H2$-$C_H3$; and (b) a second polypeptide comprising from N-terminus to C-terminus: $V_L$-$C_L$-anti-CTLA-4 sdAb, wherein $V_H$ and $V_L$ forms an antigen binding site that specifically binds PD-1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H$H domain comprising the amino acid sequence of any one of SEQ ID NOs: 113-129, 200-202, 274-282, 341-344, 352, and 353. In some embodiments, the $V_H$ and $V_L$ domains are derived from pembrolizumab or nivolumab. In some embodiments, the $V_H$ and $V_L$ domains are derived from a full-length antibody comprising a heavy chain comprising the amino acid sequence of SEQ ID NO: 158, and a light chain comprising the amino acid sequence of SEQ ID NO: 159. In some embodiments, the $V_H$ and $V_L$ domains are derived from a full-length antibody comprising a heavy chain comprising the amino acid sequence of SEQ ID NO: 160, and a light chain comprising the amino acid sequence of SEQ ID NO: 161. In some embodiments, the $V_H$ and $V_L$ domains are derived from a full-length antibody comprising a heavy chain comprising the amino acid sequence of SEQ ID NO: 308, and a light chain comprising the amino acid sequence of SEQ ID NO: 309. In some embodiments, the $C_L$ and anti-CTLA-4 sdAb are fused to each other via a peptide linker, such as a peptide linker comprising the amino acid sequence of SEQ ID NO: 162, 163, 307, or 365. In some embodiments, the $C_H2$ and $C_H3$ domains are derived from an IgG4 Fc. In some embodiments, the $C_H2$ and $C_H3$ domains are derived from an IgG1 Fc. In some embodiments, the anti-CTLA-4 BABP comprises (a) two identical copies of a first polypeptide comprising the amino acid sequence of SEQ ID NO: 158, and (b) two identical copies of a second polypeptide comprising the amino acid sequence of SEQ ID NO: 355. In some embodiments, the CTLA-4×PD-1 BABP has the structure as shown in FIG. 43.

In some embodiments, there is provided an anti-CTLA-4 bispecific antigen binding protein comprising: (a) a first polypeptide comprising from N-terminus to C-terminus: $V_H$-$C_H1$-$C_H2$-$C_H3$; and (b) a second polypeptide comprising from N-terminus to C-terminus: anti-CTLA-4 sdAb-$V_L$-$C_L$, wherein $V_H$ and $V_L$ forms an antigen binding site that specifically binds PD-1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H$H domain comprising the amino acid sequence of any one of SEQ ID NOs: 113-129, 200-202, 274-282, 341-344, 352, and 353. In some embodiments, the In some embodiments, there is provided an anti-CTLA-4 bispecific antigen binding protein comprising: (a) a first polypeptide comprising from N-terminus to C-terminus: anti-CTLA-4 sdAb-$V_H$-$C_H1$-$C_H2$-$C_H3$; and (b) a second polypeptide comprising from N-terminus to C-terminus: anti-CTLA-4 sdAb-$V_L$-$C_L$, wherein $V_H$ and $V_L$ forms an antigen binding site that specifically binds PD-1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H$H domain comprising the amino acid sequence of any one of SEQ ID NOs: 113-129, 200-202, 274-282, 341-344, 352, and 353. In some embodiments, the $V_H$ and $V_L$ domains are derived from pembrolizumab or nivolumab. In some embodiments, the $V_H$ and $V_L$ domains are derived from a full-length antibody comprising a heavy chain comprising the amino acid sequence of SEQ ID NO: 158, and a light chain comprising the amino acid sequence of SEQ ID NO: 159. In some embodiments, the $V_H$ and $V_L$ domains are derived from a full-length antibody comprising a heavy chain comprising the amino acid sequence of SEQ ID NO: 160, and a light chain comprising the amino acid sequence of SEQ ID NO: 161. In some embodiments, the $V_H$ and $V_L$ domains are derived from a full-length antibody comprising a heavy chain comprising the amino acid sequence of SEQ ID NO: 308, and a light chain comprising the amino acid sequence of SEQ ID NO: 309. In some embodiments, the $V_L$ and anti-CTLA-4 sdAb, and/or the $V_L$ and anti-CTLA-4 sdAb are fused to each other via a peptide linker, such as a peptide linker comprising the amino acid sequence of SEQ ID NO: 162, 163, 307, or 365. In some embodiments, the $C_H2$ and $C_H3$ domains are derived from an IgG4 Fc. In some embodiments, the $C_H2$ and $C_H3$ domains are derived from an IgG1 Fc. In some embodiments, the anti-CTLA-4 BABP comprises (a) two identical copies of a first polypeptide comprising the amino acid sequence of SEQ ID NO: 356, and (b) two identical copies of a second polypeptide comprising the amino acid sequence of SEQ ID NO: 357. In some embodiments, the CTLA-4× PD-1 BABP has the structure as shown in FIG. 44.

In some embodiments, there is provided an anti-CTLA-4 bispecific antigen binding protein comprising: (a) a first polypeptide comprising from N-terminus to C-terminus: anti-CTLA-4 sdAb1-anti-CTLA-4 sdAb2-$V_H$-$C_H1$-$C_H2$-$C_H3$; and (b) a second polypeptide comprising from N-terminus to C-terminus: $V_L$-$C_L$, wherein $V_H$ and $V_L$ forms an antigen binding site that specifically binds PD-1, and wherein the anti-CTLA-4 sdAb1 and anti-CTLA-4 sdAb2 comprise a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb1 and anti-CTLA-4 sdAb2 comprise a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb1 and anti-CTLA-4 sdAb2 comprise a $V_H$H domain comprising the amino acid sequence of any one of SEQ ID NOs: 113-129, 200-202, 274-282, 341-344, 352, and 353. In some embodiments, the $V_H$ and $V_L$ domains are derived from pembrolizumab or nivolumab. In some embodiments, the $V_H$ and $V_L$ domains are derived from a full-length antibody comprising a heavy chain comprising the amino acid sequence of SEQ ID NO: 158, and a light chain comprising the amino acid sequence of SEQ ID NO: 159. In some embodiments, the $V_H$ and $V_L$ domains are derived from a full-length antibody comprising a heavy chain comprising the amino acid sequence of SEQ ID NO: 160, and a light chain comprising the amino acid sequence of SEQ ID NO: 161. In some embodiments, the $V_H$ and $V_L$ domains are derived from a full-length antibody comprising a heavy chain comprising the amino acid sequence of SEQ ID NO: 308, and a light chain comprising the amino acid sequence of SEQ ID NO: 309. In some embodiments, the anti-CTLA-4 sdAb1 and anti-CTLA-4 sdAb2, and/or the $V_H$ and anti-CTLA-4 sdAb2 are fused to each other via a peptide linker, such as a peptide linker comprising the amino acid sequence of SEQ ID NO: 162, 163, 307, or 365. In some embodiments, the $C_H2$ and $C_H3$ domains are derived from an IgG4 Fc. In some embodiments, the $C_H2$ and $C_H3$ domains are derived from an IgG1 Fc. In some embodiments, the anti-CTLA-4 BABP comprises (a) two identical copies of a first polypeptide comprising the amino acid sequence of SEQ ID NO: 358, and (b) two identical copies of a second polypeptide comprising the amino acid sequence of SEQ ID NO: 159. In some embodiments, the CTLA-4× PD-1 BABP has the structure as shown in FIG. 45.

Figure 46:
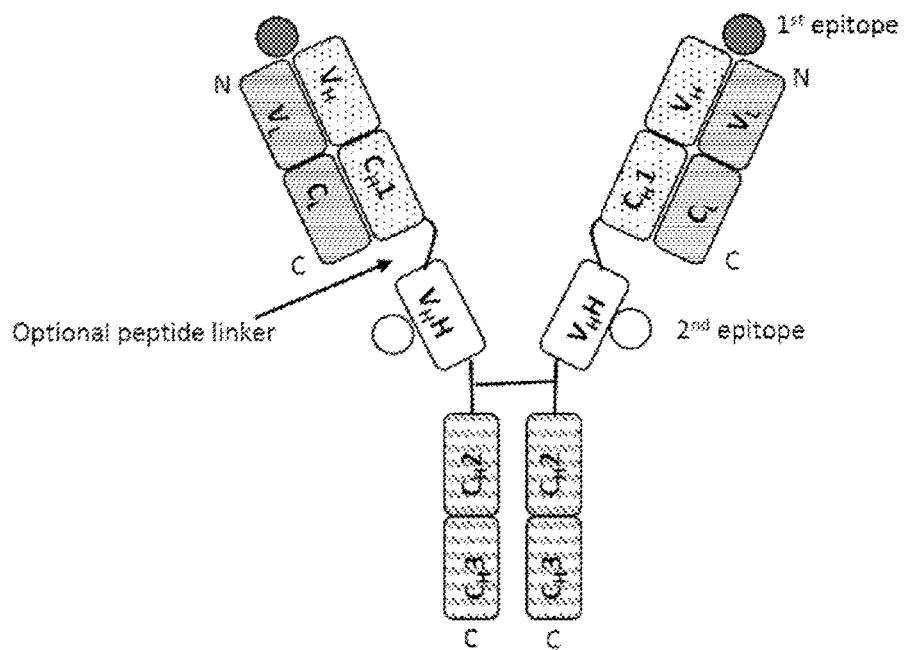
FIG. 46 depicts a schematic structure of an exemplary BABP comprising two identical antigen-binding (Fab) fragments, two identical sdAbs, and an Fc region, wherein the N-terminus of each sdAb is fused to the C-terminus of the $C_H 1$ region via an optional peptide linker and the C-terminus of each sdAb is fused to the N-terminus of the $C_H 2$ region of the Fc region. The full-length antibody has two antigen binding sites that each specifically binds a first epitope. Each sdAb specifically binds a second epitope. For example, the BABP can consist of four polypeptide chains with structures from the N-terminus to the C-terminus as follows: (1) $V_L\text{-}C_L$; (2) $V_H\text{-}C_H 1\text{-}V_H H\text{-}C_H 2\text{-}C_H 3$; (3) $V_H\text{-}C_H 1\text{-}V_H H\text{-}C_H 2\text{-}C_H 3$; and (4) $V_L\text{-}C_L$, wherein $V_H$ and $V_L$ of polypeptide chains (1) and (2) forms an antigen binding site that specifically binds a first copy of the first epitope, $V_H$ and $V_L$ of polypeptide chains (3) and (4) forms an antigen binding site that specifically binds a second copy of the first epitope, and each $V_H H$ specifically binds a copy of the second epitope. In alternative formats, each sdAb may be omitted, or replaced with two identical or different sdAbs fused to each other. The monospecific full-length antibody may be replaced with a bispecific full-length antibody to further expand binding specificity. In alternative formats, to expand specificity, the two Fab fragments can specifically bind different epitopes, and/or the $V_H H$ fragments can specifically bind different epitopes.

In some embodiments, there is provided an anti-CTLA-4 bispecific antigen binding protein comprising: (a) a first polypeptide comprising from N-terminus to C-terminus: $V_H$-$C_H1$-anti-CTLA-4 sdAb-$C_H2$-$C_H3$; and (b) a second polypeptide comprising from N-terminus to C-terminus: $V_L$-$C_L$, wherein $V_H$ and $V_L$ forms an antigen binding site that specifically binds PD-1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_H$H domain comprising the amino acid sequence of any one of SEQ ID NOs: 113-129, 200-202, 274-282, 341-344, 352, and 353. In some embodiments, the $V_H$ and $V_L$ domains are derived from pembrolizumab or nivolumab. In some embodiments, the $V_H$ and $V_L$ domains are derived from a full-length antibody comprising a heavy chain comprising the amino acid sequence of SEQ ID NO: 158, and a light chain comprising the amino acid sequence of SEQ ID NO: 159. In some embodiments, the $V_H$ and $V_L$ domains are derived from a full-length antibody comprising a heavy chain comprising the amino acid sequence of SEQ ID NO: 160, and a light chain comprising the amino acid sequence of SEQ ID NO: 161. In some embodiments, the $V_H$ and $V_L$ domains are derived from a full-length antibody comprising a heavy chain comprising the amino acid sequence of SEQ ID NO: 308, and a light chain comprising the amino acid sequence of SEQ ID NO: 309. In some embodiments, the $C_H1$ and anti-CTLA-4 sdAb are fused to each other via a peptide linker, such as a peptide linker comprising the amino acid sequence of SEQ ID NO: 162, 163, 307, or 365. In some embodiments, the $C_H2$ and $C_H3$ domains are derived from an IgG4 Fc. In some embodiments, the $C_H2$ and $C_H3$ domains are derived from an IgG1 Fc. In some embodiments, the anti-CTLA-4 BABP comprises (a) two identical copies of a first polypeptide comprising the amino acid sequence of SEQ ID NO: 359, and (b) two identical copies of a second polypeptide comprising the amino acid sequence of SEQ ID NO: 159. In some embodiments, the CTLA-4×PD-1 BABP has the structure as shown in FIG. 46.

Figure 47:
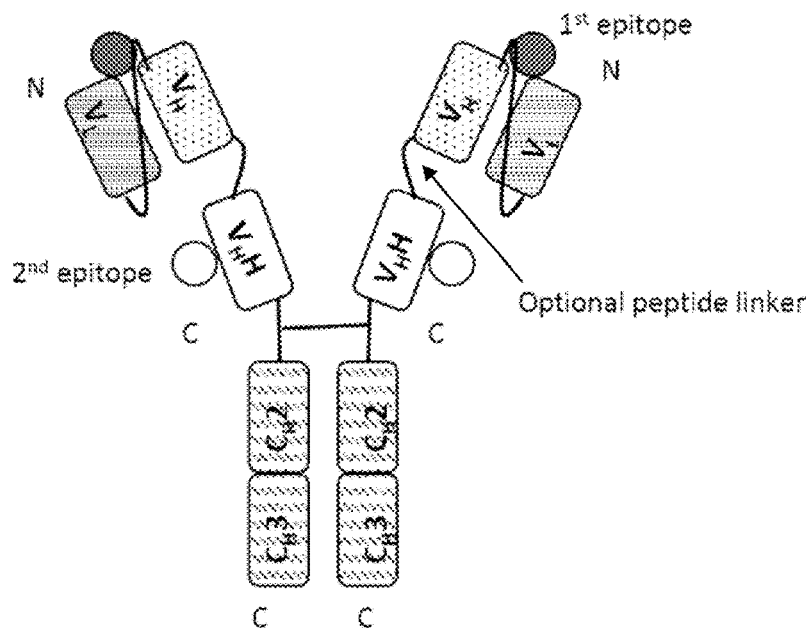
FIG. 47 depicts a schematic structure of an exemplary BABP comprising two identical single chain variable fragments (scFvs), two identical sdAbs and a fragment crystallizable (Fc) region, wherein the N-terminus of each sdAb is fused to the C-terminus of an scFv via an optional peptide linker and the C-terminus of each sdAb is fused to the N-terminus of the Fc region. Each scFv specifically binds a first epitope. Each sdAb specifically binds a second epitope.

In some embodiments, there is provided an anti-CTLA-4 bispecific antigen binding protein comprising a polypeptide comprising from N-terminus to C-terminus: scFv-anti-CTLA-4 sdAb-$C_H2$-$C_H3$, wherein the scFv specifically binds PD-1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_HH$ domain comprising the amino acid sequence of any one of SEQ ID NOs: 113-129, 200-202, 274-282, 341-344, 352, and 353. In some embodiments, the scFv is derived from pembrolizumab or nivolumab. In some embodiments, the scFv is derived from a full-length antibody comprising a heavy chain comprising the amino acid sequence of SEQ ID NO: 158, and a light chain comprising the amino acid sequence of SEQ ID NO: 159. In some embodiments, the scFv is derived from a full-length antibody comprising a heavy chain comprising the amino acid sequence of SEQ ID NO: 160, and a light chain comprising the amino acid sequence of SEQ ID NO: 161. In some embodiments, the scFv is derived from a full-length antibody comprising a heavy chain comprising the amino acid sequence of SEQ ID NO: 308, and a light chain comprising the amino acid sequence of SEQ ID NO: 309. In some embodiments, the scFv and anti-CTLA-4 sdAb are fused to each other via a peptide linker, such as a peptide linker comprising the amino acid sequence of SEQ ID NO: 162, 163, 307, or 365. In some embodiments, the $C_H2$ and $C_H3$ domains are derived from an IgG4 Fc. In some embodiments, the $C_H2$ and $C_H3$ domains are derived from an IgG1 Fc. In some embodiments, the anti-CTLA-4 BABP comprises two identical copies of a polypeptide comprising the amino acid sequence of SEQ ID NO: 360. In some embodiments, the CTLA-4×PD-1 BABP has the structure as shown in FIG. 47.

In some embodiments, there is provided an anti-CTLA-4 bispecific antigen binding protein comprising: (a) a first polypeptide comprising from N-terminus to C-terminus: $V_H$-$C_H1$-anti-CTLA-4 sdAb-$C_H1$-$C_H2$-$C_H3$; and (b) a second polypeptide comprising from N-terminus to C-terminus: $V_L$-$C_L$-anti-CTLA-4 sdAb-$C_L$, wherein $V_H$ and $V_L$ forms an antigen binding site that specifically binds PD-1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_HH$ domain comprising the amino acid sequence of any one of SEQ ID NOs: 113-129, 200-202, 274-282, 341-344, 352, and 353. In some embodiments, the $V_H$ and $V_L$ domains are derived from pembrolizumab or nivolumab. In some embodiments, the $V_H$ and $V_L$ domains are derived from a full-length antibody comprising a heavy chain comprising the amino acid sequence of SEQ ID NO: 158, and a light chain comprising the amino acid sequence of SEQ ID NO: 159. In some embodiments, the $V_H$ and $V_L$ domains are derived from a full-length antibody comprising a heavy chain comprising the amino acid sequence of SEQ ID NO: 160, and a light chain comprising the amino acid sequence of SEQ ID NO: 161. In some embodiments, the $V_H$ and $V_L$ domains are derived from a full-length antibody comprising a heavy chain comprising the amino acid sequence of SEQ ID NO: 308, and a light chain comprising the amino acid sequence of SEQ ID NO: 309. In some embodiments, the $C_H1$ and anti-CTLA-4 sdAb, and/or $C_L$ and anti-CTLA-4 sdAb are fused to each other via a peptide linker, such as a peptide linker comprising the amino acid sequence of SEQ ID NO: 162, 163, 307, or 365. In some embodiments, the $C_H2$ and $C_H3$ domains are derived from an IgG4 Fc. In some embodiments, the $C_H2$ and $C_H3$ domains are derived from an IgG1 Fc. In some embodiments, the anti-CTLA-4 BABP comprises (a) two identical copies of a first polypeptide comprising the amino acid sequence of SEQ ID NO: 361, and (b) two identical copies of a second polypeptide comprising the amino acid sequence of SEQ ID NO: 362. In some embodiments, the CTLA-4×PD-1 BABP has the structure as shown in FIG. 48.

In some embodiments, there is provided an anti-CTLA-4 bispecific antigen binding protein comprising: (a) a first polypeptide comprising from N-terminus to C-terminus: scFv-anti-CTLA-4 sdAb-$C_H2$-$C_H3$; and (b) a second polypeptide comprising from N-terminus to C-terminus: anti-CTLA-4 sdAb-$C_L$, wherein the scFv specifically binds PD-1, and wherein the anti-CTLA-4 sdAb comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions. In some embodiments, the anti-CTLA-4 sdAb comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262. In some embodiments, the anti-CTLA-4 sdAb comprises a $V_HH$ domain comprising the amino acid sequence of any one of SEQ ID NOs: 113-129, 200-202, 274-282, 341-344, 352, and 353. In some embodiments, the scFv is derived from pembrolizumab or nivolumab. In some embodiments, the scFv is derived from a full-length antibody comprising a heavy chain comprising the amino acid sequence of SEQ ID NO: 158, and a light chain comprising the amino acid sequence of SEQ ID NO: 159. In some embodiments, the scFv is derived from a full-length antibody comprising a heavy chain comprising the amino acid sequence of SEQ ID NO: 160, and a light chain comprising the amino acid sequence of SEQ ID NO: 161. In some embodiments, the scFv is derived from a full-length antibody comprising a heavy chain comprising the amino acid sequence of SEQ ID NO: 308, and a light chain comprising the amino acid sequence of SEQ ID NO: 309. In some embodiments, the scFv and anti-CTLA-4 sdAb are fused to each other via a peptide linker, such as a peptide linker comprising the amino acid sequence of SEQ ID NO: 162, 163, 307, or 365. In some embodiments, the $C_H2$ and $C_H3$ domains are derived from an IgG4 Fc. In some embodiments, the $C_H2$ and $C_H3$ domains are derived from an IgG1 Fc. In some embodiments, the anti-CTLA-4 BABP comprises (a) two identical copies of a first polypeptide comprising the amino acid sequence of SEQ ID NO: 363, and (b) two identical copies of a second polypeptide comprising the amino acid sequence of SEQ ID NO: 364. In some embodiments, the CTLA-4×PD-1 BABP has the structure as shown in FIG. 49.

In some embodiments, there is also provided an anti-CTLA-4 MABP (e.g., BABP) comprising an sdAb moiety specifically recognizing CTLA-4 (hereinafter referred to as "competing anti-CTLA-4 construct") that specifically binds to CTLA-4 competitively with any one of the anti-CTLA-4 construct described herein (such as anti-CTLA-4 sdAb, anti-CTLA-4 HCAb, multispecific or monospecific anti-CTLA-4 construct comprising an anti-CTLA-4 sdAb descried herein, e.g., anti-CTLA-4/PD-1 constructs (e.g., BABP) or anti-CTLA-4/PD-L1 constructs (e.g., BABP) described herein).

(III) Anti-CTLA-4 Antibody Variants

In some embodiments, amino acid sequence variants of the antibodies provided herein are contemplated. For example, it may be desirable to improve the binding affinity and/or other biological properties of the antibody. Amino acid sequence variants of an antibody may be prepared by introducing appropriate modifications into the nucleic acid sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding.

a) Substitution, Insertion, Deletion and Variants

In some embodiments, antibody variants having one or more amino acid substitutions are provided. Sites of interest for substitutional mutagenesis include the HVRs and FRs. Conservative substitutions are shown in Table 3 under the heading of "Preferred substitutions." More substantial changes are provided in Table 3 under the heading of "exemplary substitutions," and as further described below in reference to amino acid side chain classes. Amino acid substitutions may be introduced into an antibody of interest and the products screened for a desired activity, e.g., retained/improved antigen binding, decreased immunogenicity, or improved ADCC or CDC.

TABLE 3

Amino acid substitutions

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr, Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties:

(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class.

One type of substitutional variant involves substituting one or more hypervariable region residues of a parent antibody (e.g., a humanized or human antibody). Generally, the resulting variant(s) selected for further study will have modifications (e.g., improvements) in certain biological properties (e.g., increased affinity, reduced immunogenicity) relative to the parent antibody and/or will have substantially retained certain biological properties of the parent antibody. An exemplary substitutional variant is an affinity matured antibody, which may be conveniently generated, e.g., using phage display-based affinity maturation techniques such as those described herein. Briefly, one or more HVR residues are mutated and the variant antibodies displayed on phage and screened for a particular biological activity (e.g. binding affinity).

Alterations (e.g., substitutions) may be made in HVRs, e.g., to improve antibody affinity. Such alterations may be made in HVR "hotspots," i.e., residues encoded by codons that undergo mutation at high frequency during the somatic maturation process (see, e.g., Chowdhury, *Methods Mol. Biol.* 207:179-196 (2008)), and/or SDRs (a-CDRs), with the resulting variant VH or VL being tested for binding affinity. Affinity maturation by constructing and reselecting from secondary libraries has been described, e.g., in Hoogenboom et al. in *Methods in Molecular Biology* 178:1-37 (O'Brien et al., ed., Human Press, Totowa, N.J., (2001)) In some embodiments of affinity maturation, diversity is introduced into the variable genes chosen for maturation by any of a variety of methods (e.g., error-prone PCR, chain shuffling, or oligonucleotide-directed mutagenesis). A secondary library is then created. The library is then screened to identify any antibody variants with the desired affinity. Another method to introduce diversity involves HVR-directed approaches, in which several HVR residues (e.g., 4-6 residues at a time) are randomized. HVR residues involved in antigen binding may be specifically identified, e.g., using alanine scanning mutagenesis or modeling. CDR-H3 and CDR-L3 in particular are often targeted.

In some embodiments, substitutions, insertions, or deletions may occur within one or more HVRs so long as such alterations do not substantially reduce the ability of the antibody to bind antigen. For example, conservative alterations (e.g., conservative substitutions as provided herein) that do not substantially reduce binding affinity may be made in HVRs. Such alterations may be outside of HVR "hotspots" or CDRs. In some embodiments of the variant $V_HH$ sequences provided above, each HVR either is unaltered, or contains no more than one, two or three amino acid substitutions.

A useful method for identification of residues or regions of an antibody that may be targeted for mutagenesis is called "alanine scanning mutagenesis" as described by Cunningham and Wells (1989) *Science*, 244:1081-1085. In this method, a residue or group of target residues (e.g., charged residues such as Arg, Asp, His, Lys, and Glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antibody complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme (e.g., for ADEPT) or a polypeptide which increases the serum half-life of the antibody.

b) Glycosylation Variants

In some embodiments, an anti-CTLA-4 construct provided herein is altered to increase or decrease the extent to which the construct is glycosylated. Addition or deletion of glycosylation sites to an antibody may be conveniently accomplished by altering the amino acid sequence such that one or more glycosylation sites is created or removed.

Where the anti-CTLA-4 construct comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al. *TIBTECH* 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in an anti-CTLA-4 construct of the present application may be made in order to create antibody variants with certain improved properties.

In some embodiments, antibody variants are provided having a carbohydrate structure that lacks fucose attached (directly or indirectly) to an Fc region. For example, the amount of fucose in such antibody may be from 1% to 80%, from 1% to 65%, from 5% to 65% or from 20% to 40%. The amount of fucose is determined by calculating the average amount of fucose within the sugar chain at Asn297, relative to the sum of all glycostructures attached to Asn 297 (e.g., complex, hybrid and high mannose structures) as measured by MALDI-TOF mass spectrometry, as described in WO 2008/077546, for example. Asn297 refers to the asparagine residue located at about position 297 in the Fc region (EU numbering of Fc region residues); however, Asn297 may also be located about ±3 amino acids upstream or downstream of position 297, i.e., between positions 294 and 300, due to minor sequence variations in antibodies. Such fucosylation variants may have improved ADCC function. See, e.g., US Patent Publication Nos. US 2003/0157108 (Presta, L.); US 2004/0093621 (Kyowa Hakko Kogyo Co., Ltd). Examples of publications related to "defucosylated" or "fucose-deficient" antibody variants include: US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; WO2002/031140; Okazaki et al. *J. Mol. Biol.* 336:1239-1249 (2004); Yamane-Ohnuki et al. *Biotech. Bioeng.* 87: 614 (2004). Examples of cell lines capable of producing defucosylated antibodies include Led 3 CHO cells deficient in protein fucosylation (Ripka et al. *Arch. Biochem. Biophys.* 249:533-545 (1986); US Patent Application No. US 2003/0157108 A1, Presta, L; and WO 2004/056312 A1, Adams et al., especially at Example 11), and knockout cell lines, such as alpha-1,6-fucosyltransferase gene, FUT8, knockout CHO cells (see, e.g., Yamane-Ohnuki et al. *Biotech. Bioeng.* 87: 614 (2004); Kanda, Y. et al., *Biotechnol. Bioeng.*, 94(4): 680-688 (2006); and WO2003/085107).

Anti-CTLA-4 construct variants are further provided with bisected oligosaccharides, e.g., in which a biantennary oligosaccharide attached to the Fc region of the antibody is bisected by GlcNAc. Such antibody variants may have reduced fucosylation and/or improved ADCC function. Examples of such antibody variants are described, e.g., in WO 2003/011878 (Jean-Mairet et al.); U.S. Pat. No. 6,602,684 (Umana et al.); and US 2005/0123546 (Umana et al.). Antibody variants with at least one galactose residue in the oligosaccharide attached to the Fc region are also provided. Such antibody variants may have improved CDC function. Such antibody variants are described, e.g., in WO 1997/30087 (Patel et al.); WO 1998/58964 (Raju, S.); and WO 1999/22764 (Raju, S.).

c) Fc Region Variants

In some embodiments, one or more amino acid modifications may be introduced into the Fc region of the anti-CTLA-4 construct provided herein, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions.

In some embodiments, the present application contemplates an anti-CTLA-4 construct variant that possesses some but not all effector functions, which make it a desirable candidate for applications in which the half-life of the anti-CTLA-4 construct in vivo is important yet certain effector functions (such as complement and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the antibody lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII FcR expression on hematopoietic cells is summarized in Table 3 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g. Hellstrom, I. et al. *Proc. Nat'l Acad. Sci. USA* 83:7059-7063 (1986)) and Hellstrom, I et al., *Proc. Nat'l Acad. Sci. USA* 82:1499-1502 (1985); U.S. Pat. No. 5,821,337 (see Bruggemann, M. et al., *J. Exp. Med.* 166:1351-1361 (1987)). Alternatively, non-radioactive assays methods may be employed (see, for example, ACTI™ non-radioactive cytotoxicity assay for flow cytometry (CellTechnology, Inc. Mountain View, Calif.; and CytoTox 96® non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. *Proc. Nat'l Acad. Sci. USA* 95:652-656 (1998). C1q binding assays may also be carried out to confirm that the antibody is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101:1045-1052 (2003); and Cragg, M. S. and M. J. Glennie, *Blood* 103:2738-2743 (2004)). FcRn binding and in vivo clearance/half-life determinations can also be performed using methods known in the art (see, e.g., Petkova, S. B. et al., *Int'l. Immunol.* 18(12):1759-1769 (2006)).

Antibodies with reduced effector function include those with substitution of one or more of Fc region residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581).

Certain antibody variants with improved or diminished binding to FcRs are described. (See, e.g., U.S. Pat. No. 6,737,056; WO 2004/056312, and Shields et al., *J. Biol. Chem.* 9(2): 6591-6604 (2001).)

In some embodiments, an anti-CTLA-4 construct variant comprises an Fc region with one or more amino acid substitutions which improve ADCC, e.g., substitutions at positions 298, 333, and/or 334 of the Fc region (EU numbering of residues).

In some embodiments, alterations are made in the Fc region that result in altered (i.e., either improved or diminished) C1q binding and/or Complement Dependent Cytotoxicity (CDC), e.g., as described in U.S. Pat. No. 6,194,551, WO 99/51642, and Idusogie et al. *J. Immunol.* 164: 4178-4184 (2000).

In some embodiments, there is provided an anti-CTLA-4 construct (e.g., a HCAb) variant comprising a variant Fc region comprising one or more amino acid substitutions which increase half-life and/or improve binding to the neonatal Fc receptor (FcRn). Antibodies with increased half-lives and improved binding to the neonatal Fc receptor (FcRn), which is responsible for the transfer of maternal IgGs to the fetus (Guyer et al., *J. Immunol.* 117:587 (1976) and Kim et al., *J. Immunol.* 24:249 (1994)), are described in US2005/0014934A1 (Hinton et al.). Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826).

See also Duncan & Winter, *Nature* 322:738-40 (1988); U.S. Pat. Nos. 5,648,260; 5,624,821; and WO 94/29351 concerning other examples of Fc region variants.

Anti-CTLA-4 constructs (such as HCAb, anti-CTLA-4 sdAb fused to a full-length antibody, or anti-CTLA-4 MABP/BABP described herein) comprising any of the Fc variants described herein, or combinations thereof, are contemplated.

d) Cysteine Engineered Antibody Variants

In some embodiments, it may be desirable to create cysteine engineered anti-CTLA-4 constructs, e.g., "thioMAbs," in which one or more residues of an antibody are substituted with cysteine residues. In particular embodiments, the substituted residues occur at accessible sites of the antibody. By substituting those residues with cysteine, reactive thiol groups are thereby positioned at accessible sites of the antibody and may be used to conjugate the antibody to other moieties, such as drug moieties or linker-drug moieties, to create an immunoconjugate, as described further herein. In some embodiments, any one or more of the following residues may be substituted with cysteine: A118 (EU numbering) of the heavy chain; and S400 (EU numbering) of the heavy chain Fc region. Cysteine engineered anti-CTLA-4 constructs may be generated as described, e.g., in U.S. Pat. No. 7,521,541.

e) Antibody Derivatives

In some embodiments, an anti-CTLA-4 construct provided herein may be further modified to comprise additional nonproteinaceous moieties that are known in the art and readily available. The moieties suitable for derivatization of the antibody include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer are attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

In some embodiments, conjugates of an anti-CTLA-4 construct and nonproteinaceous moiety that may be selectively heated by exposure to radiation are provided. In some embodiments, the nonproteinaceous moiety is a carbon nanotube (Kam et al., *Proc. Natl. Acad. Sci. USA* 102: 11600-11605 (2005)). The radiation may be of any wavelength, and includes, but is not limited to, wavelengths that do not harm ordinary cells, but which heat the nonproteinaceous moiety to a temperature at which cells proximal to the antibody-nonproteinaceous moiety are killed.

In some embodiments, an anti-CTLA-4 construct provided herein (such as anti-CTLA-4 sdAb, anti-CTLA-4 HCAb, anti-CTLA-4/PD-1 bispecific antibody, anti-CTLA-4/PD-L1 bispecific antibody, or anti-CTLA-4 MABP (e.g., BABP)) may be further modified to comprise one or more biologically active protein, polypeptides or fragments thereof. "Bioactive" or "biologically active", as used herein interchangeably, means showing biological activity in the body to carry out a specific function. For example, it may mean the combination with a particular biomolecule such as protein, DNA, etc., and then promotion or inhibition of the activity of such biomolecule. In some embodiments, the bioactive protein or fragments thereof include proteins and polypeptides that are administered to patients as the active drug substance for prevention of or treatment of a disease or condition, as well as proteins and polypeptides that are used for diagnostic purposes, such as enzymes used in diagnostic tests or in vitro assays, as well as proteins and polypeptides that are administered to a patient to prevent a disease such as a vaccine. In some embodiments, the bioactive protein or fragments thereof have immune-stimulatory/immune-regulatory, membrane transport, or enzymatic activities. In some embodiments, the biologically active protein, polypeptides or fragments thereof is an enzyme, a hormone, a growth factor, a cytokine, or a mixture thereof. In some embodiments, the biologically active protein, polypeptides or fragments can specifically recognize a target peptide (such as antigen, or other proteins).

In some embodiments, the bioactive protein or fragments thereof that can be comprised within the anti-CTLA-4 construct described herein is a protein-binding protein. In some embodiments, the bioactive protein or fragments thereof that can be comprised within the anti-CTLA-4 construct described herein is an antibody mimetics, which are small engineered proteins comprising antigen-binding domains reminiscent of antibodies (Geering and Fussenegger, Trends Biotechnol., 33(2):65-79, 2015). These molecules are derived from existing human scaffold proteins and comprise a single polypeptide. Exemplary antibody mimetics that can be comprised within the anti-CTLA-4 construct described herein can be, but are not limited to, a Designed ankyrin repeat protein (DARPin; comprising 3-5 fully synthetic ankyrin repeats flanked by N- and C-terminal Cap domains), an avidity multimer (avimer; a high-affinity protein comprising multiple A domains, each domain with low affinity for a target), or an Anticalin (based on the scaffold of lipocalins, with four accessible loops, the sequence of each can be randomized). In some embodiments, the bioactive protein or fragments thereof that can be comprised within the anti-CTLA-4 construct described herein is an Armadillo repeat protein (e.g., β-catenin, α-importin, plakoglobin, adenomatous polyposis coli (APC)), which comprises armadillo repeat units (characteristic, repetitive amino acid sequence of about 40 residues in length). Each Armadillo repeat is composed of a pair of alpha helices that form a hairpin structure. Multiple copies of the repeat form what is known as an alpha solenoid structure. Armadillo repeat proteins are able to bind different types of peptides, relying on a constant way of binding of the peptide backbone without requiring specific conserved side chains or interactions with free N- or C-termini of a peptide. The possibility of recognizing a peptide residue by residue, combined with the intrinsic modularity of a repeat protein, makes the armadillo repeat proteins promising candidates for the design of a generic scaffold for peptide binding.

In some embodiments, the biologically active protein or fragments thereof that can be comprised within the anti-CTLA-4 construct described herein is a ligand, such as lymphokines and cellular factors which interact with specific cellular receptor. Lymphokines are low molecular weight proteins which are secreted by T cells when antigens or lectins stimulate T cell growth.

III. Pharmaceutical Compositions

Further provided by the present application are pharmaceutical compositions comprising any one of the anti-CTLA-4 constructs comprising a sdAb specifically recognizing CTLA-4 as described herein (such as anti-CTLA-4 sdAb, anti-CTLA-4 HCAb, anti-CTLA-4/PD-1 bispecific antibody (e.g., CTLA-4×PD-1 BABP), or anti-CTLA-4/PD-L1 bispecific antibody (e.g., CTLA-4×PD-L1 BABP)), and optionally a pharmaceutically acceptable carrier. Pharmaceutical compositions can be prepared by mixing an anti-CTLA-4 construct described herein having the desired degree of purity with optional pharmaceutically acceptable carriers, excipients or stabilizers (Remington's Pharmaceutical Sciences 16th edition, Osol, A. Ed. (1980)), in the form of lyophilized formulations or aqueous solutions.

The pharmaceutical composition is preferably to be stable, in which the anti-CTLA-4 construct comprising anti-CTLA-4 sdAb described here essentially retains its physical and chemical stability and integrity upon storage. Various analytical techniques for measuring protein stability are available in the art and are reviewed in *Peptide and Protein Drug Delivery*, 247-301, Vincent Lee Ed., Marcel Dekker, Inc., New York, N.Y., Pubs. (1991) and Jones, A. *Adv. Drug Delivery Rev.* 10: 29-90 (1993). Stability can be measured at a selected temperature for a selected time period. For rapid screening, the formulation may be kept at 40° C. for 2 weeks to 1 month, at which time stability is measured. Where the formulation is to be stored at 2-8° C., generally the formulation should be stable at 30° C. or 40° C. for at least 1 month, and/or stable at 2-8° C. for at least 2 years. Where the formulation is to be stored at 30° C., generally the formulation should be stable for at least 2 years at 30° C., and/or stable at 40° C. for at least 6 months. For example, the extent of aggregation during storage can be used as an indicator of protein stability. In some embodiments, the stable formulation of anti-CTLA-4 construct described herein may comprise less than about 10% (preferably less than about 5%) of the anti-CTLA-4 construct present as an aggregate in the formulation.

Acceptable carriers, excipients, or stabilizers are nontoxic to recipients at the dosages and concentrations employed, and include buffers, antioxidants including ascorbic acid, methionine, Vitamin E, sodium metabisulfite; preservatives, isotonicifiers (e.g. sodium chloride), stabilizers, metal complexes (e.g. Zn-protein complexes); chelating agents such as EDTA and/or non-ionic surfactants.

Examples of physiologically acceptable carriers include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugars such as sucrose, mannitol, trehalose or sorbitol; salt-forming counterions such as sodium; metal complexes (e.g. Zn-protein complexes); and/or nonionic surfactants such as TWEEN™, polyethylene glycol (PEG), and PLURONICS™ or polyethylene glycol (PEG).

Buffers are used to control the pH in a range which optimizes the therapeutic effectiveness, especially if stability is pH dependent. Buffers are preferably present at concentrations ranging from about 50 mM to about 250 mM. Suitable buffering agents for use in the present application include both organic and inorganic acids and salts thereof. For example, citrate, phosphate, succinate, tartrate, fumarate, gluconate, oxalate, lactate, acetate. Additionally, buffers may comprise histidine and trimethylamine salts such as Tris.

Preservatives are added to retard microbial growth, and are typically present in a range from 0.2%-1.0% (w/v). The addition of a preservative may, for example, facilitate the production of a multi-use (multiple-dose) formulation. Suitable preservatives for use in the present application include octadecyldimethylbenzyl ammonium chloride; hexamethonium chloride; benzalkonium halides (e.g., chloride, bromide, iodide), benzethonium chloride; thimerosal, phenol, butyl or benzyl alcohol; alkyl parabens such as methyl or propyl paraben; catechol; resorcinol; cyclohexanol, 3-pentanol, and m-cresol.

Tonicity agents, sometimes known as "stabilizers" are present to adjust or maintain the tonicity of liquid in a composition. When used with large, charged biomolecules such as proteins and antibodies, they are often termed "stabilizers" because they can interact with the charged groups of the amino acid side chains, thereby lessening the potential for inter and intra-molecular interactions. Tonicity agents can be present in any amount between 0.1% to 25% by weight, preferably 1% to 5%, taking into account the relative amounts of the other ingredients. Preferred tonicity agents include polyhydric sugar alcohols, preferably trihydric or higher sugar alcohols, such as glycerin, erythritol, arabitol, xylitol, sorbitol and mannitol.

Additional excipients include agents which can serve as one or more of the following: (1) bulking agents, (2) solubility enhancers, (3) stabilizers and (4) and agents preventing denaturation or adherence to the container wall. Such excipients include: polyhydric sugar alcohols (enumerated above); amino acids such as alanine, glycine, glutamine, asparagine, histidine, arginine, lysine, ornithine, leucine, 2-phenylalanine, glutamic acid, threonine, etc.; organic sugars or sugar alcohols such as sucrose, lactose, lactitol, trehalose, stachyose, mannose, sorbose, xylose, ribose, ribitol, myoinisitose, myoinisitol, galactose, galactitol, glycerol, cyclitols (e.g., inositol), polyethylene glycol; sulfur containing reducing agents, such as urea, glutathione, thioctic acid, sodium thioglycolate, thioglycerol, α-monothioglycerol and sodium thio sulfate; low molecular weight proteins such as human serum albumin, bovine serum albumin, gelatin or other immunoglobulins; hydrophilic polymers such as polyvinylpyrrolidone; monosaccharides (e.g., xylose, mannose, fructose, glucose; disaccharides (e.g., lactose, maltose, sucrose); trisaccharides such as raffinose; and polysaccharides such as dextrin or dextran.

Non-ionic surfactants or detergents (also known as "wetting agents") are present to help solubilize the therapeutic agent as well as to protect the therapeutic protein against agitation-induced aggregation, which also permits the formulation to be exposed to shear surface stress without causing denaturation of the active therapeutic protein or antibody. Non-ionic surfactants are present in a range of about 0.05 mg/ml to about 1.0 mg/ml, preferably about 0.07 mg/ml to about 0.2 mg/ml.

Suitable non-ionic surfactants include polysorbates (20, 40, 60, 65, 80, etc.), polyoxamers (184, 188, etc.), PLURONIC® polyols, TRITON®, polyoxyethylene sorbitan monoethers (TWEEN®-20, TWEEN®-80, etc.), lauromacrogol 400, polyoxyl 40 stearate, polyoxyethylene hydrogenated castor oil 10, 50 and 60, glycerol monostearate, sucrose fatty acid ester, methyl cellouse and carboxymethyl cellulose. Anionic detergents that can be used include sodium lauryl sulfate, dioctyle sodium sulfosuccinate and dioctyl sodium sulfonate. Cationic detergents include benzalkonium chloride or benzethonium chloride.

In order for the pharmaceutical compositions to be used for in vivo administration, they must be sterile. The pharmaceutical composition may be rendered sterile by filtration through sterile filtration membranes. The pharmaceutical compositions herein generally are placed into a container having a sterile access port, for example, an intravenous solution bag or vial having a stopper pierceable by a hypodermic injection needle.

The route of administration is in accordance with known and accepted methods, such as by single or multiple bolus or infusion over a long period of time in a suitable manner, e.g., injection or infusion by subcutaneous, intravenous, intraperitoneal, intramuscular, intra-arterial, intralesional or intraarticular routes, topical administration, inhalation or by sustained release or extended-release means. In some embodiments, the pharmaceutical composition is administered locally, such as intratumorally.

Sustained-release preparations may be prepared. Suitable examples of sustained-release preparations include semipermeable matrices of solid hydrophobic polymers containing the antagonist, which matrices are in the form of shaped articles, e.g. films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and. ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid.

The pharmaceutical compositions herein may also contain more than one active compound as necessary for the particular indication being treated, preferably those with complementary activities that do not adversely affect each other. Alternatively, or in addition, the composition may comprise a cytotoxic agent, chemotherapeutic agent, cytokine, immunosuppressive agent, or growth inhibitory agent. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in *Remington's Pharmaceutical Sciences* 18th edition.

In some embodiments, the pharmaceutical composition is contained in a single-use vial, such as a single-use sealed vial. In some embodiments, the pharmaceutical composition is contained in a multi-use vial. In some embodiments, the pharmaceutical composition is contained in bulk in a container. In some embodiments, the pharmaceutical composition is cryopreserved.

IV. Methods of Treating CTLA-4 Related Diseases

The anti-CTLA-4 construct comprising sdAb specifically recognizing CTLA-4 as described herein (such as anti-CTLA-4 sdAb, anti-CTLA-4 HCAb, anti-CTLA-4/PD-1 bispecific antibody (e.g., CTLA-4×PD-1 BABP), or anti-CTLA-4/PD-L1 bispecific antibody (e.g., CTLA-4×PD-L1 BABP)), and the compositions (such as pharmaceutical compositions) thereof are useful for a variety of applications, such as in diagnosis, molecular assays, and therapy.

One aspect of the invention provides a method of treating a CTLA-4 related disease or a condition in an individual in need thereof, comprising administering to the individual an effective amount of a pharmaceutical composition comprising the anti-CTLA-4 construct described herein. In some embodiments, the CTLA-4 related disease is cancer. In some embodiments, the CTLA-4 related disease is pathogenic infection, such as viral infection.

The present invention contemplates, in part, protein constructs (such as anti-CTLA-4 sdAb, anti-CTLA-4 HCAb, anti-CTLA-4/PD-1 bispecific antibody (e.g., CTLA-4×PD-1 BABP), or anti-CTLA-4/PD-L1 bispecific antibody (e.g., CTLA-4×PD-L1 BABP)), nucleic acid molecules and/or vectors encoding thereof, host cells comprising nucleic acid molecules and/or vectors encoding thereof, that can be administered either alone or in any combination with another therapy, and in at least some aspects, together with a pharmaceutically acceptable carrier or excipient. In some embodiments, prior to administration of the anti-CTLA-4 construct, they may be combined with suitable pharmaceutical carriers and excipients that are well known in the art. The compositions prepared according to the disclosure can be used for the treatment or delaying of worsening of cancer.

In some embodiments, there is provided a method of treating cancer comprising administering to the individual an effective amount of a pharmaceutical composition comprising an isolated anti-CTLA-4 construct comprising a single-domain antibody (sdAb) moiety specifically recognizing CTLA-4 (such as anti-CTLA-4 sdAb, anti-CTLA-4 HCAb, anti-CTLA-4/PD-1 bispecific antibody (e.g., CTLA-4×PD-1 BABP), or anti-CTLA-4/PD-L1 bispecific antibody (e.g., CTLA-4×PD-L1 BABP)), wherein the sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions; and optionally a pharmaceutical acceptable carrier. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the sdAb moiety specifically recognizing CTLA-4 is camelid, chimeric, human, partially humanized, or fully humanized. In some embodiments, the cancer is a solid tumor (such as colon cancer). In some embodiments, the pharmaceutical composition is administered systemically (such as intravenously or intraperitoneally). In some embodiments, the pharmaceutical composition is administered locally (such as intratumorally). In some embodiments, the method further comprises administering to the individual an additional cancer therapy (such as surgery, radiation, chemotherapy, immunotherapy, hormone therapy, or a combination thereof). In some embodiments, the individual is a human. In some embodiments, the method of treating cancer has one or more of the following biological activities: (1) killing cancer cells (including bystander killing); (2) inhibiting proliferation of cancer cells; (3) inducing immune response in a tumor; (4) reducing tumor size; (5) alleviating one or more symptoms in an individual having cancer; (6) inhibiting tumor metastasis; (7) prolonging survival; (8) prolonging time to cancer progression; and (9) preventing, inhibiting, or reducing the likelihood of the recurrence of a cancer. In some embodiments, the method of killing cancer cells mediated by the pharmaceutical composition described herein can achieve a tumor cell death rate of at least about any of 40%, 50%, 60%, 70%, 80%, 90%, 95%, or more. In some embodiments, the method of killing cancer cells mediated by the pharmaceutical composition described herein can achieve a bystander tumor cell (uninfected by the oncolytic VV) death rate of at least about any of 10%, 20%, 30%, 40%, 50%, 60%, 70%, 80%, 90%, 95%, or more. In some embodiments, the method of reducing tumor size mediated by the pharmaceutical composition described herein can reduce at least about 10% (including for example at least about any of 20%, 30%, 40%, 60%, 70%, 80%, 90%, or 100%) of the tumor size. In some embodiments, the method of inhibiting tumor metastasis mediated by the pharmaceutical composition described herein can inhibit at least about 10% (including for example at least about any of 20%, 30%, 40%, 60%, 70%, 80%, 90%, or 100%) of the metastasis. In some embodiments, the method of prolonging survival of an individual (such as a human) mediated by the pharmaceutical composition described herein can prolongs the survival of the individual by at least any of 1, 2, 3, 4, 5, 6, 7, 8, 9, 10, 11, 12, 18, or 24 months. In some embodiments, the method of prolonging time to cancer progression mediated by the pharmaceutical composition described herein can prolongs the time to cancer progression by at least any of 1, 2, 3, 4, 5, 6, 7, 8, 9, 10, 11, or 12 weeks.

The methods described herein are suitable for treating a variety of cancers, including both solid cancer and liquid cancer. The methods are applicable to cancers of all stages, including early stage cancer, non-metastatic cancer, primary cancer, advanced cancer, locally advanced cancer, metastatic cancer, or cancer in remission. The methods described herein may be used as a first therapy, second therapy, third therapy, or combination therapy with other types of cancer therapies known in the art, such as chemotherapy, surgery, hormone therapy, radiation, gene therapy, immunotherapy (such as T-cell therapy), bone marrow transplantation, stem cell transplantation, targeted therapy, cryotherapy, ultrasound therapy, photodynamic therapy, radio-frequency ablation or the like, in an adjuvant setting or a neoadjuvant setting (i.e., the method may be carried out before the primary/definitive therapy). In some embodiments, the method is used to treat an individual who has previously been treated. In some embodiments, the cancer has been refractory to prior therapy. In some embodiments, the method is used to treat an individual who has not previously been treated.

In some embodiments, the method is suitable for treating cancers with aberrant CTLA-4 expression, activity and/or signaling include, by way of non-limiting example, melanoma, prostate cancer, lung cancer, colon cancer, gastric cancer, ovarian cancer, breast cancer, and glioblastoma.

Thus in some embodiments, there is provided a method of treating an immunotherapy-responsive solid tumor (such as carcinoma or adenocarcinoma, such as cancers with aberrant CTLA-4 expression, activity and/or signaling), comprising administering to the individual an effective amount of a pharmaceutical composition comprising an isolated anti-CTLA-4 construct comprising a sdAb moiety specifically recognizing CTLA-4 (such as anti-CTLA-4 sdAb, anti-CTLA-4 HCAb, anti-CTLA-4/PD-1 bispecific antibody (e.g., CTLA-4×PD-1 BABP), or anti-CTLA-4/PD-L1 bispecific antibody (e.g., CTLA-4×PD-L1 BABP)), wherein the sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions; and optionally a pharmaceutical acceptable carrier. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the sdAb moiety specifically recognizing CTLA-4 is camelid, chimeric, human, partially humanized, or fully humanized. In some embodiments, the cancer is a solid tumor (such as colon cancer). In some embodiments, the pharmaceutical composition is administered systemically (such as intravenously or intraperitoneally). In some embodiments, the pharmaceutical composition is administered locally (such as intratumorally). In some embodiments, the method further comprises administering to the individual an additional cancer therapy (such as surgery, radiation, chemotherapy, immunotherapy, hormone therapy, or a combination thereof). In some embodiments, the individual is a human. In some embodiments, the method of treating cancer has one or more of the following biological activities: (1) killing cancer cells (including bystander killing); (2) inhibiting proliferation of cancer cells; (3) inducing immune response in a tumor; (4) reducing tumor size; (5) alleviating one or more symptoms in an individual having cancer; (6) inhibiting tumor metastasis; (7) prolonging survival; (8) prolonging time to cancer progression; and (9) preventing, inhibiting, or reducing the likelihood of the recurrence of a cancer. In some embodiments, the method of killing cancer cells mediated by the pharmaceutical composition described herein can achieve a tumor cell death rate of at least about any of 40%, 50%, 60%, 70%, 80%, 90%, 95%, or more. In some embodiments, the method of killing cancer cells mediated by the pharmaceutical composition described herein can achieve a bystander tumor cell (uninfected by the oncolytic VV) death rate of at least about any of 10%, 20%, 30%, 40%, 50%, 60%, 70%, 80%, 90%, 95%, or more. In some embodiments, the method of reducing tumor size mediated by the pharmaceutical composition described herein can reduce at least about 10% (including for example at least about any of 20%, 30%, 40%, 60%, 70%, 80%, 90%, or 100%) of the tumor size. In some embodiments, the method of inhibiting tumor metastasis mediated by the pharmaceutical composition described herein can inhibit at least about 10% (including for example at least about any of 20%, 30%, 40%, 60%, 70%, 80%, 90%, or 100%) of the metastasis. In some embodiments, the method of prolonging survival of an individual (such as a human) mediated by the pharmaceutical composition described herein can prolongs the survival of the individual by at least any of 1, 2, 3, 4, 5, 6, 7, 8, 9, 10, 11, 12, 18, or 24 months. In some embodiments, the method of prolonging time to cancer progression mediated by the pharmaceutical composition described herein can prolongs the time to cancer progression by at least any of 1, 2, 3, 4, 5, 6, 7, 8, 9, 10, 11, or 12 weeks.

In some embodiments, the method is suitable for treating cancers with aberrant PD-1 or PD-L1/PD-L2 expression, activity and/or signaling include, by way of non-limiting example, hematological cancer and/or solid tumors. Some cancers whose growth may be inhibited using the antibodies of the invention include cancers typically responsive to immunotherapy. Non-limiting examples of other cancers for treatment include melanoma (e.g., metastatic malignant melanoma), renal cancer (e.g. clear cell carcinoma), prostate cancer (e.g. hormone refractory prostate adenocarcinoma), breast cancer, colon cancer and lung cancer (e.g. non-small cell lung cancer). Additionally, the invention includes refractory or recurrent malignancies whose growth may be inhibited using the antibodies of the invention. Examples of other cancers that may be treated using the antibodies of the invention include bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, chronic or acute leukemias including acute myeloid leukemia, chronic myeloid leukemia, acute lymphoblastic leukemia, chronic lymphocytic leukemia, solid tumors of childhood, lymphocytic lymphoma, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers including those induced by asbestos, and combinations of said cancers. The present invention is also useful for treatment of metastatic cancers, especially metastatic cancers that express PD-L1 (Iwai et al. (2005) *Int. Immunol.* 17:133-144).

Thus in some embodiments, there is provided a method of treating an immunotherapy-responsive solid tumor (such as carcinoma or adenocarcinoma, such as cancers with aberrant CTLA-4 expression, activity and/or signaling, and/or aberrant PD-1/PD-L1 expression, activity and/or signaling), comprising administering to the individual an effective amount of a pharmaceutical composition comprising an anti-CTLA-4 construct (e.g., MABP or BABP) comprising: (a) a first antigen binding portion comprising an anti-CTLA-4 sdAb moiety comprising a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and (b) a second antigen binding portion comprising a heavy chain variable domain ($V_H$) and a light chain variable domain ($V_L$), wherein the $V_H$ and $V_L$ together form an antigen-binding site that specifically binds PD-1, wherein the first antigen binding portion is fused to the second antigen binding portion at the N-terminus of the heavy chain, the N-terminus of the light chain, the N-terminus of the Fc region, the C-terminus of the heavy chain, or the C-terminus of the light chain. In some embodiments, the second antigen binding portion is an anti-PD-1 full-length 4-chain antibody or antigen binding fragment thereof. In some embodiments, the $V_H$ and $V_L$ domains are derived from pembrolizumab or nivolumab. In some embodiments, the $V_H$ and $V_L$ domains are derived from a full-length antibody comprising a heavy chain comprising the amino acid sequence of SEQ ID NO: 158, and a light chain comprising the amino acid sequence of SEQ ID NO: 159. In some embodiments, the $V_H$ and $V_L$ domains are derived from a full-length antibody comprising a heavy chain comprising the amino acid sequence of SEQ ID NO: 160, and a light chain comprising the amino acid sequence of SEQ ID NO: 161. In some embodiments, the $V_H$ and $V_L$ domains are derived from a full-length antibody comprising a heavy chain comprising the amino acid sequence of SEQ ID NO: 308, and a light chain comprising the amino acid sequence of SEQ ID NO: 309. In some embodiments, the second antigen binding portion comprises a Fab. In some embodiments, the second antigen binding portion comprises an scFv. In some embodiments, the first and second antigen binding portions are fused via a peptide linker, such as a peptide linker comprising the amino acid sequence of SEQ ID NO: 162, 163, 307, or 365. In some embodiments, the second antigen binding portion comprises an Fc fragment (e.g. derived from IgG4 or IgG1). In some embodiments, there is provided a method of treating an immunotherapy-responsive solid tumor (such as carcinoma or adenocarcinoma, such as cancers with aberrant CTLA-4 expression, activity and/or signaling, and/or aberrant PD-1/PD-L1 expression, activity and/or signaling), comprising administering to the individual an effective amount of a pharmaceutical composition comprising an isolated anti-CTLA-4 construct comprising a single-domain antibody (sdAb) moiety specifically recognizing CTLA-4 fused to a PD-1 full-length antibody, wherein the sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions; and optionally a pharmaceutical acceptable carrier. In some embodiments, the full-length antibody comprises a heavy chain comprising the amino acid sequence of SEQ ID NO: 158, and a light chain comprising the amino acid sequence of SEQ ID NO: 159. In some embodiments, the full-length antibody comprises a heavy chain comprising the amino acid sequence of SEQ ID NO: 160, and a light chain comprising the amino acid sequence of SEQ ID NO: 161. In some embodiments, the full-length antibody comprises a heavy chain comprising the amino acid sequence of SEQ ID NO: 308, and a light chain comprising the amino acid sequence of SEQ ID NO: 309. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$M, or about $10^{-8}$M to about $10^{-12}$ M). In some embodiments, the sdAb moiety specifically recognizing CTLA-4 is camelid, chimeric, human, partially humanized, or fully humanized. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb, wherein the C-terminus of each anti-CTLA-4 sdAb is fused to the N-terminus of each chain of the full-length antibody. In some embodiments, the anti-CTLA-4 construct comprises four anti-CTLA-4 sdAb, wherein two anti-CTLA-4 sdAbs are fused together, which is further fused to the N-terminus of each heavy chain of the full-length antibody. In some embodiments, the sdAb moiety specifically recognizing CTLA-4 comprises a $V_HH$ domain comprising the amino acid sequence of any one of SEQ ID NOs: 113-129, 200-202, 274-282, 341-344, 352, and 353. In some embodiments, the sdAb moiety specifically recognizing CTLA-4 and the second antibody moiety (e.g., full length antibody) are optionally connected by a peptide linker (such as peptide linker comprising the amino acid sequence of SEQ ID NO: 162, 163, 307, or 365). In some embodiments, the anti-CTLA-4 construct comprises (a) two identical copies of a first polypeptide comprising the amino acid sequence of any of SEQ ID NOs: 134-145, 292-296, 319-323, 358, and 359, and (b) two identical copies of a second polypeptide comprising the amino acid sequence of SEQ ID NO: 159. In some embodiments, the anti-CTLA-4 construct comprises (a) two identical copies of a first polypeptide comprising the amino acid sequence of SEQ ID NO: 158, and (b) two identical copies of a second polypeptide comprising the amino acid sequence of SEQ ID NO: 354 or 355. In some embodiments, the anti-CTLA-4 construct comprises (a) two identical copies of a first polypeptide comprising the amino acid sequence of SEQ ID NO: 356, and (b) two identical copies of a second polypeptide comprising the amino acid sequence of SEQ ID NO: 357. In some embodiments, the anti-CTLA-4 construct comprises (a) two identical copies of a first polypeptide comprising the amino acid sequence of SEQ ID NO: 361, and (b) two identical copies of a second polypeptide comprising the amino acid sequence of SEQ ID NO: 362. In some embodiments, the anti-CTLA-4 construct comprises (a) two identical copies of a first polypeptide comprising the amino acid sequence of SEQ ID NO: 363, and (b) two identical copies of a second polypeptide comprising the amino acid sequence of SEQ ID NO: 364. In some embodiments, the anti-CTLA-4 construct comprises two identical copies of a polypeptide comprising the amino acid sequence of SEQ ID NO: 360. In some embodiments, the anti-CTLA-4 construct comprises (a) two identical copies of a first polypeptide comprising the amino acid sequence of any of SEQ ID NOs: 146-157, 297-301, and 324-328, and (b) two identical copies of a second polypeptide comprising the amino acid sequence of SEQ ID NO: 161. In some embodiments, the anti-CTLA-4 construct comprises (a) two identical copies of a first polypeptide comprising the amino acid sequence of any of SEQ ID NOs: 310-318 and 329-337, and (b) two identical copies of a second polypeptide comprising the amino acid sequence of SEQ ID NO: 309. In some embodiments, the cancer is a solid tumor (such as colon cancer). In some embodiments, the pharmaceutical composition is administered systemically (such as intravenously or intraperitoneally). In some embodiments, the pharmaceutical composition is administered locally (such as intratumorally). In some embodiments, the method further comprises administering to the individual an additional cancer therapy (such as surgery, radiation, chemotherapy, immunotherapy, hormone therapy, or a combination thereof). In some embodiments, the individual is a human. In some embodiments, the method of treating cancer has one or more of the following biological activities: (1) killing cancer cells (including bystander killing); (2) inhibiting proliferation of cancer cells; (3) inducing immune response in a tumor; (4) reducing tumor size; (5) alleviating one or more symptoms in an individual having cancer; (6) inhibiting tumor metastasis; (7) prolonging survival; (8) prolonging time to cancer progression; and (9) preventing, inhibiting, or reducing the likelihood of the recurrence of a cancer. In some embodiments, the method of killing cancer cells mediated by the pharmaceutical composition described herein can achieve a tumor cell death rate of at least about any of 40%, 50%, 60%, 70%, 80%, 90%, 95%, or more. In some embodiments, the method of killing cancer cells mediated by the pharmaceutical composition described herein can achieve a bystander tumor cell (uninfected by the oncolytic VV) death rate of at least about any of 10%, 20%, 30%, 40%, 50%, 60%, 70%, 80%, 90%, 95%, or more. In some embodiments, the method of reducing tumor size mediated by the pharmaceutical composition described herein can reduce at least about 10% (including for example at least about any of 20%, 30%, 40%, 60%, 70%, 80%, 90%, or 100%) of the tumor size. In some embodiments, the method of inhibiting tumor metastasis mediated by the pharmaceutical composition described herein can inhibit at least about 10% (including for example at least about any of 20%, 30%, 40%, 60%, 70%, 80%, 90%, or 100%) of the metastasis. In some embodiments, the method of prolonging survival of an individual (such as a human) mediated by the pharmaceutical composition described herein can prolongs the survival of the individual by at least any of 1, 2, 3, 4, 5, 6, 7, 8, 9, 10, 11, 12, 18, or 24 months. In some embodiments, the method of prolonging time to cancer progression mediated by the pharmaceutical composition described herein can prolongs the time to cancer progression by at least any of 1, 2, 3, 4, 5, 6, 7, 8, 9, 10, 11, or 12 weeks.

In some embodiments, there is provided a method of treating an immunotherapy-responsive solid tumor (such as carcinoma or adenocarcinoma, such as cancers with aberrant CTLA-4 expression, activity and/or signaling, and/or aberrant PD-1/PD-L1 expression, activity and/or signaling), comprising administering to the individual an effective amount of a pharmaceutical composition comprising an anti-CTLA-4 construct (e.g., MABP or BABP) comprising: (a) a first antigen binding portion comprising an anti-CTLA-4 sdAb moiety comprising a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions, and (b) a second antigen binding portion comprising a heavy chain variable domain ($V_H$) and a light chain variable domain ($V_L$), wherein the $V_H$ and $V_L$ together form an antigen-binding site that specifically binds PD-L1, wherein the first antigen binding portion is fused to the second antigen binding portion at the N-terminus of the heavy chain, the N-terminus of the light chain, the N-terminus of the Fc region, the C-terminus of the heavy chain, or the C-terminus of the light chain. In some embodiments, the second antigen binding portion is an anti-PD-L1 full-length 4-chain antibody or antigen binding fragment thereof. In some embodiments, the $V_H$ and $V_L$ domains are derived from atezolizumab or durvalumab. In some embodiments, the $V_H$ and $V_L$ domains are derived from a full-length antibody comprising a heavy chain comprising the amino acid sequence of SEQ ID NO: 195, and a light chain comprising the amino acid sequence of SEQ ID NO: 196. In some embodiments, the $V_H$ and $V_L$ domains are derived from a full-length antibody comprising a heavy chain comprising the amino acid sequence of SEQ ID NO: 197, and a light chain comprising the amino acid sequence of SEQ ID NO: 198. In some embodiments, the second antigen binding portion comprises a Fab. In some embodiments, the second antigen binding portion comprises an scFv. In some embodiments, the first antigen binding portion and second antigen binding portion (e.g., full-length antibody) are fused via a peptide linker, such as a peptide linker comprising the amino acid sequence of SEQ ID NO: 162, 163, 307, or 365. In some embodiments, the second antigen binding portion comprises an Fc fragment (e.g. derived from IgG4 or IgG1). In some embodiments, there is provided a method of treating an immunotherapy-responsive solid tumor (such as carcinoma or adenocarcinoma, such as cancers with aberrant CTLA-4 expression, activity and/or signaling, and/or aberrant PD-1/PD-L1 expression, activity and/or signaling), comprising administering to the individual an effective amount of a pharmaceutical composition comprising an isolated anti-CTLA-4 construct comprising a single-domain antibody (sdAb) moiety specifically recognizing CTLA-4 fused to a PD-L1 full-length antibody, wherein the sdAb moiety comprises a CDR1 comprising the amino acid sequence of any one of SEQ ID NOs: 17-32 and 213-222, or a variant thereof comprising up to about 3 (such as about any of 1, 2, or 3) amino acid substitutions; a CDR2 comprising the amino acid sequence of any one of SEQ ID NOs: 49-64, 233-242, and 339, or a variant thereof comprising up to about 3 (such as about any of 1, 2, or 3) amino acid substitutions; and a CDR3 comprising the amino acid sequence of any one of SEQ ID NOs: 81-96 and 253-262, or a variant thereof comprising up to about 3 (such as about any of 1, 2, or 3) amino acid substitutions; and optionally a pharmaceutical acceptable carrier. In some embodiments, the $K_d$ of the binding between the anti-CTLA-4 sdAb moiety and CTLA-4 is about $10^{-5}$ M to about $10^{-12}$ M (such as about $10^{-7}$ M to about $10^{-12}$ M, or about $10^{-8}$ M to about $10^{-12}$ M). In some embodiments, the full-length antibody comprises a heavy chain comprising the amino acid sequence of SEQ ID NO: 195, and a light chain comprising the amino acid sequence of SEQ ID NO: 196. In some embodiments, the full-length antibody comprises a heavy chain comprising the amino acid sequence of SEQ ID NO: 197, and a light chain comprising the amino acid sequence of SEQ ID NO: 198. In some embodiments, the sdAb moiety specifically recognizing CTLA-4 is camelid, chimeric, human, partially humanized, or fully humanized. In some embodiments, the N-terminus of the sdAb moiety specifically recognizing CTLA-4 is fused to the C-terminus of at least one of the heavy chains of the full-length antibody. In some embodiments, the C-terminus of the sdAb moiety specifically recognizing CTLA-4 is fused to the N-terminus of at least one of the heavy chains of the full-length antibody. In some embodiments, the N-terminus of the sdAb moiety specifically recognizing CTLA-4 is fused to the C-terminus of at least one of the light chains of the full-length antibody. In some embodiments, the C-terminus of the sdAb moiety specifically recognizing CTLA-4 is fused to the N-terminus of at least one of the light chains of the full-length antibody. In some embodiments, the anti-CTLA-4 construct comprises four anti-CTLA-4 sdAb, wherein the C-terminus of each anti-CTLA-4 sdAb is fused to the N-terminus of each chain of the full-length antibody. In some embodiments, the anti-CTLA-4 construct comprises four anti-CTLA-4 sdAb, wherein two anti-CTLA-4 sdAbs are fused together, which is further fused to the N-terminus of each heavy chain of the full-length antibody. In some embodiments, the sdAb moiety specifically recognizing CTLA-4 comprises a $V_HH$ domain comprising the amino acid sequence of any one of SEQ ID NOs: 113-129, 200-202, 274-282, 341-344, 352, and 353. In some embodiments, the sdAb moiety specifically recognizing CTLA-4 and the second antibody moiety (e.g., full-length antibody) are optionally connected by a peptide linker (such as peptide linker comprising the amino acid sequence of SEQ ID NO: 162, 163, 307, or 365). In some embodiments, the anti-CTLA-4 construct comprises (a) two identical copies of a first polypeptide comprising the amino acid sequence of any of SEQ ID NOs: 171-182, 302-306, and 345-349, and (b) two identical copies of a second polypeptide comprising the amino acid sequence of SEQ ID NO: 196. In some embodiments, the anti-CTLA-4 construct comprises (a) two identical copies of a first polypeptide comprising the amino acid sequence of any of SEQ ID NOs: 183-194, and (b) two identical copies of a second polypeptide comprising the amino acid sequence of SEQ ID NO: 198. In some embodiments, the cancer is a solid tumor (such as colon cancer). In some embodiments, the pharmaceutical composition is administered systemically (such as intravenously or intraperitoneally). In some embodiments, the pharmaceutical composition is administered locally (such as intratumorally). In some embodiments, the method further comprises administering to the individual an additional cancer therapy (such as surgery, radiation, chemotherapy, immunotherapy, hormone therapy, or a combination thereof). In some embodiments, the individual is a human. In some embodiments, the method of treating cancer has one or more of the following biological activities: (1) killing cancer cells (including bystander killing); (2) inhibiting proliferation of cancer cells; (3) inducing immune response in a tumor; (4) reducing tumor size; (5) alleviating one or more symptoms in an individual having cancer; (6) inhibiting tumor metastasis; (7) prolonging survival; (8) prolonging time to cancer progression; and (9) preventing, inhibiting, or reducing the likelihood of the recurrence of a cancer. In some embodiments, the method of killing cancer cells mediated by the pharmaceutical composition described herein can achieve a tumor cell death rate of at least about any of 40%, 50%, 60%, 70%, 80%, 90%, 95%, or more. In some embodiments, the method of killing cancer cells mediated by the pharmaceutical composition described herein can achieve a bystander tumor cell (uninfected by the oncolytic VV) death rate of at least about any of 10%, 20%, 30%, 40%, 50%, 60%, 70%, 80%, 90%, 95%, or more. In some embodiments, the method of reducing tumor size mediated by the pharmaceutical composition described herein can reduce at least about 10% (including for example at least about any of 20%, 30%, 40%, 60%, 70%, 80%, 90%, or 100%) of the tumor size. In some embodiments, the method of inhibiting tumor metastasis mediated by the pharmaceutical composition described herein can inhibit at least about 10% (including for example at least about any of 20%, 30%, 40%, 60%, 70%, 80%, 90%, or 100%) of the metastasis. In some embodiments, the method of prolonging survival of an individual (such as a human) mediated by the pharmaceutical composition described herein can prolongs the survival of the individual by at least any of 1, 2, 3, 4, 5, 6, 7, 8, 9, 10, 11, 12, 18, or 24 months. In some embodiments, the method of prolonging time to cancer progression mediated by the pharmaceutical composition described herein can prolongs the time to cancer progression by at least any of 1, 2, 3, 4, 5, 6, 7, 8, 9, 10, 11, or 12 weeks.

In some embodiments, the method described herein is suitable for treating a colorectal cancer, such as adenocarcinoma, gastrointestinal carcinoid tumor, gastrointestinal stromal tumor, Leiomyosarcoma, melanoma, or squamous cell carcinoma.

Dosages and desired drug concentrations of pharmaceutical compositions of the present application may vary depending on the particular use envisioned. The determination of the appropriate dosage or route of administration is well within the skill of an ordinary artisan. Animal experiments provide reliable guidance for the determination of effective doses for human therapy. Interspecies scaling of effective doses can be performed following the principles laid down by Mordenti, J. and Chappell, W. "The Use of Interspecies Scaling in Toxicokinetics," In *Toxicokinetics and New Drug Development*, Yacobi et al., Eds, Pergamon Press, New York 1989, pp. 42-46.

When in vivo administration of the anti-CTLA-4 construct comprising an anti-CTLA-4 sdAb moiety described herein are used, normal dosage amounts may vary from about 10 ng/kg up to about 100 mg/kg of mammal body weight or more per day, preferably about 1 mg/kg/day to 10 mg/kg/day, such as about 1-3 mg/kg/day, about 2-4 mg/kg/day, about 3-5 mg/kg/day, about 4-6 mg/kg/day, about 5-7 mg/kg/day, about 6-8 mg/kg/day, about 6-6.5 mg/kg/day, about 6.5-7 mg/kg/day, about 7-9 mg/kg/day, or about 8-10 mg/kg/day, depending upon the route of administration. It is within the scope of the present application that different formulations will be effective for different treatments and different disorders, and that administration intended to treat a specific organ or tissue may necessitate delivery in a manner different from that to another organ or tissue. Moreover, dosages may be administered by one or more separate administrations, or by continuous infusion. For repeated administrations over several days or longer, depending on the condition, the treatment is sustained until a desired suppression of disease symptoms occurs. However, other dosage regimens may be useful. The progress of this therapy is easily monitored by conventional techniques and assays.

In some embodiments, the pharmaceutical composition is administered for a single time (e.g. bolus injection). In some embodiments, the pharmaceutical composition is administered for multiple times (such as any of 2, 3, 4, 5, 6, or more times). If multiple administrations, they may be performed by the same or different routes and may take place at the same site or at alternative sites. The pharmaceutical composition may be administered twice per week, 3 times per week, 4 times per week, 5 times per week, daily, daily without break, once per week, weekly without break, once per 2 weeks, once per 3 weeks, once per month, once per 2 months, once per 3 months, once per 4 months, once per 5 months, once per 6 months, once per 7 months, once per 8 months, once per 9 months, once per 10 months, once per 11 months, or once per year. The interval between administrations can be about any one of 24 h to 48 h, 2 days to 3 days, 3 days to 5 days, 5 days to 1 week, 1 week to 2 weeks, 2 weeks to 1 month, 1 month to 2 months, 2 month to 3 months, 3 months to 6 months, or 6 months to a year. Intervals can also be irregular (e.g. following tumor progression). In some embodiments, there is no break in the dosing schedule. In some embodiments, the pharmaceutical composition is administered every 4 days for 4 times. The optimal dosage and treatment regime for a particular patient can readily be determined by one skilled in the art of medicine by monitoring the patient for signs of disease and adjusting the treatment accordingly.

The pharmaceutical compositions of the present application, including but not limited to reconstituted and liquid formulations, are administered to an individual in need of treatment with the anti-CTLA-4 construct described herein, preferably a human, in accord with known methods, such as intravenous administration as a bolus or by continuous infusion over a period of time, by intramuscular, intraperitoneal, intracerobrospinal, subcutaneous, intravenous (i.v.), intra-articular, intrasynovial, intrathecal, oral, topical, or inhalation routes. A reconstituted formulation can be prepared by dissolving a lyophilized anti-CTLA-4 construct described herein in a diluent such that the protein is dispersed throughout. Exemplary pharmaceutically acceptable (safe and non-toxic for administration to a human) diluents suitable for use in the present application include, but are not limited to, sterile water, bacteriostatic water for injection (BWFI), a pH buffered solution (e.g. phosphate-buffered saline), sterile saline solution, Ringer's solution or dextrose solution, or aqueous solutions of salts and/or buffers.

In some embodiments, the pharmaceutical compositions are administered to the individual by subcutaneous (i.e. beneath the skin) administration. For such purposes, the pharmaceutical compositions may be injected using a syringe. However, other devices for administration of the pharmaceutical compositions are available such as injection devices; injector pens; auto-injector devices, needleless devices; and subcutaneous patch delivery systems.

In some embodiments, the pharmaceutical compositions are administered to the individual intravenously. In some embodiments, the pharmaceutical composition is administered to an individual by infusion, such as intravenous infusion. Infusion techniques for immunotherapy are known in the art (see, e.g., Rosenberg et al., New Eng. J. of Med. 319: 1676 (1988)).

V. Methods of Preparation

The anti-CTLA-4 construct (such as anti-CTLA-4 single-domain antibodies) described herein may be prepared using any methods known in the art or as described herein. Also see Examples 1-4, 6, and 8.

Methods of preparing single-domain antibodies have been described. See, for example, Els Pardon et al, *Nature Protocol,* 2014; 9(3): 674. Single-domain antibodies (such as $V_HH$s) may be obtained using methods known in the art such as by immunizing a Camelid species (such as camel or llama) and obtaining hybridomas therefrom, or by cloning a library of single-domain antibodies using molecular biology techniques known in the art and subsequent selection by ELISA with individual clones of unselected libraries or by using phage display.

For recombinant production of the single-domain antibodies, the nucleic acids encoding the single-domain antibodies are isolated and inserted into a replicable vector for further cloning (amplification of the DNA) or for expression. DNA encoding the single-domain antibody is readily isolated and sequenced using conventional procedures (e.g., by using oligonucleotide probes that are capable of binding specifically to genes encoding the heavy and light chains of the antibody). Many vectors are available. The choice of vector depends in part on the host cell to be used. Generally, preferred host cells are of either prokaryotic or eukaryotic (generally mammalian) origin.

1. Recombinant Production in Prokaryotic Cells
a) Vector Construction

Polynucleic acid sequences encoding the antibodies of the present application can be obtained using standard recombinant techniques. Desired polynucleic acid sequences may be isolated and sequenced from antibody producing cells such as hybridoma cells. Alternatively, polynucleotides can be synthesized using nucleotide synthesizer or PCR techniques. Once obtained, sequences encoding the polypeptides are inserted into a recombinant vector capable of replicating and expressing heterologous polynucleotides in prokaryotic hosts. Many vectors that are available and known in the art can be used for the purpose of the present invention. Selection of an appropriate vector will depend mainly on the size of the nucleic acids to be inserted into the vector and the particular host cell to be transformed with the vector. Each vector contains various components, depending on its function (amplification or expression of heterologous polynucleotide, or both) and its compatibility with the particular host cell in which it resides. The vector components generally include, but are not limited to: an origin of replication, a selection marker gene, a promoter, a ribosome binding site (RBS), a signal sequence, the heterologous nucleic acid insert and a transcription termination sequence.

In general, plasmid vectors containing replicon and control sequences which are derived from species compatible with the host cell are used in connection with these hosts. The vector ordinarily carries a replication site, as well as marking sequences which are capable of providing phenotypic selection in transformed cells. For example, *E. coli* is typically transformed using pBR322, a plasmid derived from an *E. coli* species. pBR322 contains genes encoding ampicillin (Amp) and tetracycline (Tet) resistance and thus provides easy means for identifying transformed cells. pBR322, its derivatives, or other microbial plasmids or bacteriophage may also contain, or be modified to contain, promoters which can be used by the microbial organism for expression of endogenous proteins. Examples of pBR322 derivatives used for expression of particular antibodies are described in detail in Carter et al., U.S. Pat. No. 5,648,237.

In addition, phage vectors containing replicon and control sequences that are compatible with the host microorganism can be used as transforming vectors in connection with these hosts. For example, bacteriophage such as GEM™-11 may be utilized in making a recombinant vector which can be used to transform susceptible host cells such as *E. coli* LE392.

The expression vector of the present application may comprise two or more promoter-cistron pairs, encoding each of the polypeptide components. A promoter is an untranslated regulatory sequence located upstream (5') to a cistron that modulates its expression. Prokaryotic promoters typically fall into two classes, inducible and constitutive. Inducible promoter is a promoter that initiates increased levels of transcription of the cistron under its control in response to changes in the culture condition, e.g. the presence or absence of a nutrient or a change in temperature.

A large number of promoters recognized by a variety of potential host cells are well known. The selected promoter can be operably linked to cistron DNA encoding the light or heavy chain by removing the promoter from the source DNA via restriction enzyme digestion and inserting the isolated promoter sequence into the vector of the present application. Both the native promoter sequence and many heterologous promoters may be used to direct amplification and/or expression of the target genes. In some embodiments, heterologous promoters are utilized, as they generally permit greater transcription and higher yields of expressed target gene as compared to the native target polypeptide promoter.

Promoters suitable for use with prokaryotic hosts include the PhoA promoter, the -galactamase and lactose promoter systems, a tryptophan (trp) promoter system and hybrid promoters such as the tac or the trc promoter. However, other promoters that are functional in bacteria (such as other known bacterial or phage promoters) are suitable as well. Their nucleic acid sequences have been published, thereby enabling a skilled worker operably to ligate them to cistrons encoding the target light and heavy chains (Siebenlist et al. (1980) *Cell* 20: 269) using linkers or adaptors to supply any required restriction sites.

In one aspect, each cistron within the recombinant vector comprises a secretion signal sequence component that directs translocation of the expressed polypeptides across a membrane. In general, the signal sequence may be a component of the vector, or it may be a part of the target polypeptide DNA that is inserted into the vector. The signal sequence selected for the purpose of this invention should be one that is recognized and processed (i.e. cleaved by a signal peptidase) by the host cell. For prokaryotic host cells that do not recognize and process the signal sequences native to the heterologous polypeptides, the signal sequence is substituted by a prokaryotic signal sequence selected, for example, from the group consisting of the alkaline phosphatase, penicillinase, Ipp, or heat-stable enterotoxin II (STII) leaders, LamB, PhoE, PelB, OmpA and MBP. In some embodiments of the present application, the signal sequences used in both cistrons of the expression system are STII signal sequences or variants thereof.

In some embodiments, the production of the antibodies according to the present application can occur in the cytoplasm of the host cell, and therefore does not require the presence of secretion signal sequences within each cistron. In some embodiments, polypeptide components, such as the polypeptide encoding the $V_H$ domain of the second antigen binding portion optionally fused to the first antigen binding portion, and the polypeptide encoding the $V_L$ domain of the second antigen binding portion optionally fused to the first antigen binding portion, are expressed, folded and assembled to form functional antibodies within the cytoplasm. Certain host strains (e.g., the *E. coli* trxB⁻ strains) provide cytoplasm conditions that are favorable for disulfide bond formation, thereby permitting proper folding and assembly of expressed protein subunits. Proba and Pluckthun *Gene*, 159:203 (1995).

The present invention provides an expression system in which the quantitative ratio of expressed polypeptide components can be modulated in order to maximize the yield of secreted and properly assembled the antibodies of the present application. Such modulation is accomplished at least in part by simultaneously modulating translational strengths for the polypeptide components. One technique for modulating translational strength is disclosed in Simmons et al., U.S. Pat. No. 5,840,523. It utilizes variants of the translational initiation region (TIR) within a cistron. For a given TIR, a series of amino acid or nucleic acid sequence variants can be created with a range of translational strengths, thereby providing a convenient means by which to adjust this factor for the desired expression level of the specific chain. TIR variants can be generated by conventional mutagenesis techniques that result in codon changes which can alter the amino acid sequence, although silent changes in the nucleic acid sequence are preferred. Alterations in the TIR can include, for example, alterations in the number or spacing of Shine-Dalgarno sequences, along with alterations in the signal sequence. One method for generating mutant signal sequences is the generation of a "codon bank" at the beginning of a coding sequence that does not change the amino acid sequence of the signal sequence (i.e., the changes are silent). This can be accomplished by changing the third nucleotide position of each codon; additionally, some amino acids, such as leucine, serine, and arginine, have multiple first and second positions that can add complexity in making the bank. This method of mutagenesis is described in detail in Yansura et al. (1992) *METHODS: A Companion to Methods in Enzymol.* 4:151-158.

Preferably, a set of vectors is generated with a range of TIR strengths for each cistron therein. This limited set provides a comparison of expression levels of each chain as well as the yield of the desired protein products under various TIR strength combinations. TIR strengths can be determined by quantifying the expression level of a reporter gene as described in detail in Simmons et al. U.S. Pat. No. 5,840,523. Based on the translational strength comparison, the desired individual TIRs are selected to be combined in the expression vector constructs of the present application.

b) Prokaryotic Host Cells

Prokaryotic host cells suitable for expressing the antibodies of the present application include Archaebacteria and Eubacteria, such as Gram-negative or Gram-positive organisms. Examples of useful bacteria include *Escherichia* (e.g., *E. coli*), Bacilli (e.g., *B. subtilis*), Enterobacteria, *Pseudomonas* species (e.g., *P. aeruginosa*), *Salmonella typhimurium, Serratia marcescans, Klebsiella, Proteus, Shigella, Rhizobia, Vitreoscilla,* or *Paracoccus*. In some embodiments, gram-negative cells are used. In some embodiments, *E. coli* cells are used as hosts for the invention. Examples of *E. coli* strains include strain W3110 (Bachmann, *Cellular and Molecular Biology*, vol. 2 (Washington, D.C.: American Society for Microbiology, 1987), pp. 1190-1219; ATCC Deposit No. 27,325) and derivatives thereof, including strain 33D3 having genotype W3110 ΔfhuA (ΔtonA) ptr3 lac Iq lacL8 ΔompT Δ(nmpc-fepE) degP41 kan$^R$ (U.S. Pat. No. 5,639,635). Other strains and derivatives thereof, such as *E. coli* 294 (ATCC 31,446), *E. coli* B, *E. coli* 1776 (ATCC 31,537) and *E. coli* RV308 (ATCC 31,608) are also suitable. These examples are illustrative rather than limiting. Methods for constructing derivatives of any of the above-mentioned bacteria having defined genotypes are known in the art and described in, for example, Bass et al., *Proteins*, 8:309-314 (1990). It is generally necessary to select the appropriate bacteria taking into consideration replicability of the replicon in the cells of a bacterium. For example, *E. coli, Serratia*, or *Salmonella* species can be suitably used as the host when well known plasmids such as pBR322, pBR325, pACYC177, or pKN410 are used to supply the replicon.

Typically the host cell should secrete minimal amounts of proteolytic enzymes, and additional protease inhibitors may desirably be incorporated in the cell culture.

c) Protein Production

Host cells are transformed with the above-described expression vectors and cultured in conventional nutrient media modified as appropriate for inducing promoters, selecting transformants, or amplifying the genes encoding the desired sequences. Transformation means introducing DNA into the prokaryotic host so that the DNA is replicable, either as an extrachromosomal element or by chromosomal integrant. Depending on the host cell used, transformation is done using standard techniques appropriate to such cells. The calcium treatment employing calcium chloride is generally used for bacterial cells that contain substantial cell-wall barriers. Another method for transformation employs polyethylene glycol/DMSO. Yet another technique used is electroporation.

Host cells are transformed with the above-described expression vectors and cultured in conventional nutrient media modified as appropriate for inducing promoters, selecting transformants, or amplifying the genes encoding the desired sequences. Transformation means introducing DNA into the prokaryotic host so that the DNA is replicable, either as an extrachromosomal element or by chromosomal integrant. Depending on the host cell used, transformation is done using standard techniques appropriate to such cells. The calcium treatment employing calcium chloride is generally used for bacterial cells that contain substantial cell-wall barriers. Another method for transformation employs polyethylene glycol/DMSO. Yet another technique used is electroporation.

Prokaryotic cells used to produce the antibodies of the present application are grown in media known in the art and suitable for culture of the selected host cells. Examples of suitable media include luria broth (LB) plus necessary nutrient supplements. In some embodiments, the media also contains a selection agent, chosen based on the construction of the expression vector, to selectively permit growth of prokaryotic cells containing the expression vector. For example, ampicillin is added to media for growth of cells expressing ampicillin resistant gene.

Any necessary supplements besides carbon, nitrogen, and inorganic phosphate sources may also be included at appropriate concentrations introduced alone or as a mixture with another supplement or medium such as a complex nitrogen source. Optionally the culture medium may contain one or more reducing agents selected from the group consisting of glutathione, cysteine, cystamine, thioglycollate, dithioerythritol and dithiothreitol. The prokaryotic host cells are cultured at suitable temperatures. For *E. coli* growth, for example, the preferred temperature ranges from about 20° C. to about 39° C., more preferably from about 25° C. to about 37° C., even more preferably at about 30° C. The pH of the medium may be any pH ranging from about 5 to about 9, depending mainly on the host organism. For *E. coli*, the pH is preferably from about 6.8 to about 7.4, and more preferably about 7.0.

If an inducible promoter is used in the expression vector of the present application, protein expression is induced under conditions suitable for the activation of the promoter. In one aspect of the present application, PhoA promoters are used for controlling transcription of the polypeptides. Accordingly, the transformed host cells are cultured in a phosphate-limiting medium for induction. Preferably, the phosphate-limiting medium is the C.R.A.P medium (see, e.g., Simmons et al., *J. Immunol. Methods* (2002), 263:133-147). A variety of other inducers may be used, according to the vector construct employed, as is known in the art.

The expressed antibodies of the present application are secreted into and recovered from the periplasm of the host cells. Protein recovery typically involves disrupting the microorganism, generally by such means as osmotic shock, sonication or lysis. Once cells are disrupted, cell debris or whole cells may be removed by centrifugation or filtration. The proteins may be further purified, for example, by affinity resin chromatography. Alternatively, proteins can be transported into the culture media and isolated therein. Cells may be removed from the culture and the culture supernatant being filtered and concentrated for further purification of the proteins produced. The expressed polypeptides can be further isolated and identified using commonly known methods such as polyacrylamide gel electrophoresis (PAGE) and Western blot assay.

Alternatively, protein production is conducted in large quantity by a fermentation process. Various large-scale fed-batch fermentation procedures are available for production of recombinant proteins. Large-scale fermentations have at least 1000 liters of capacity, preferably about 1,000 to 100,000 liters of capacity. These fermentors use agitator impellers to distribute oxygen and nutrients, especially glucose (the preferred carbon/energy source). Small scale fermentation refers generally to fermentation in a fermentor that is no more than approximately 100 liters in volumetric capacity, and can range from about 1 liter to about 100 liters.

During the fermentation process, induction of protein expression is typically initiated after the cells have been grown under suitable conditions to a desired density, e.g., an $OD_{550}$ of about 180-220, at which stage the cells are in the early stationary phase. A variety of inducers may be used, according to the vector construct employed, as is known in the art and described above. Cells may be grown for shorter periods prior to induction. Cells are usually induced for about 12-50 hours, although longer or shorter induction time may be used.

To improve the production yield and quality of the antibodies of the present application, various fermentation conditions can be modified. For example, to improve the proper assembly and folding of the secreted polypeptides, additional vectors overexpressing chaperone proteins, such as Dsb proteins (DsbA, DsbB, DsbC, DsbD and or DsbG) or FkpA (a peptidylprolyl cis, trans-isomerase with chaperone activity) can be used to co-transform the host prokaryotic cells. The chaperone proteins have been demonstrated to facilitate the proper folding and solubility of heterologous proteins produced in bacterial host cells. Chen et al. (1999) *J Bio Chem* 274:19601-19605; Georgiou et al., U.S. Pat. No. 6,083,715; Georgiou et al., U.S. Pat. No. 6,027,888; Bothmann and Pluckthun (2000) J. Biol. Chem. 275:17100-17105; Ramm and Pluckthun (2000) J. Biol. Chem. 275: 17106-17113; Arie et al. (2001) *Mol. Microbiol.* 39:199-210.

To minimize proteolysis of expressed heterologous proteins (especially those that are proteolytically sensitive), certain host strains deficient for proteolytic enzymes can be used for the present invention. For example, host cell strains may be modified to effect genetic mutation(s) in the genes encoding known bacterial proteases such as Protease III, OmpT, DegP, Tsp, Protease I, Protease Mi, Protease V, Protease VI and combinations thereof. Some *E. coli* protease-deficient strains are available and described in, for example, Joly et al. (1998), supra; Georgiou et al., U.S. Pat. No. 5,264,365; Georgiou et al., U.S. Pat. No. 5,508,192; Hara et al., *Microbial Drug Resistance*, 2:63-72 (1996).

*E. coli* strains deficient for proteolytic enzymes and transformed with plasmids overexpressing one or more chaperone proteins may be used as host cells in the expression system encoding the antibodies of the present application.

d) Protein Purification

The antibodies produced herein are further purified to obtain preparations that are substantially homogeneous for further assays and uses. Standard protein purification methods known in the art can be employed. The following procedures are exemplary of suitable purification procedures: fractionation on immunoaffinity or ion-exchange columns, ethanol precipitation, reverse phase HPLC, chromatography on silica or on a cation-exchange resin such as DEAE, chromatofocusing, SDS-PAGE, ammonium sulfate precipitation, and gel filtration using, for example, Sephadex G-75.

In one aspect, Protein A immobilized on a solid phase is used for immunoaffinity purification of the antibodies comprising an Fc region of the present application. Protein A is a 411(D cell wall protein from *Staphylococcus aureas* which binds with a high affinity to the Fc region of antibodies. Lindmark et al (1983) *J. Immunol. Meth.* 62:1-13. The solid phase to which Protein A is immobilized is preferably a column comprising a glass or silica surface, more preferably a controlled pore glass column or a silicic acid column. In some applications, the column has been coated with a reagent, such as glycerol, in an attempt to prevent nonspecific adherence of contaminants. The solid phase is then washed to remove contaminants non-specifically bound to the solid phase. Finally the antibodies of interest are recovered from the solid phase by elution.

2. Recombinant Production in Eukaryotic Cells

For eukaryotic expression, the vector components generally include, but are not limited to, one or more of the following, a signal sequence, an origin of replication, one or more marker genes, and enhancer element, a promoter, and a transcription termination sequence.

a) Signal Sequence Component

A vector for use in a eukaryotic host may also an insert that encodes a signal sequence or other polypeptide having a specific cleavage site at the N-terminus of the mature protein or polypeptide. The heterologous signal sequence selected preferably is one that is recognized and processed (i.e., cleaved by a signal peptidase) by the host cell. In mammalian cell expression, mammalian signal sequences as well as viral secretory leaders, for example, the herpes simplex gD signal, are available.

The DNA for such precursor region is ligated in reading frame to DNA encoding the antibodies of the present application.

b) Origin of Replication

Generally, the origin of replication component is not needed for mammalian expression vectors (the SV40 origin may typically be used only because it contains the early promoter).

c) Selection Gene Component

Expression and cloning vectors may contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli.

One example of a selection scheme utilizes a drug to arrest growth of a host cell. Those cells that are successfully transformed with a heterologous gene produce a protein conferring drug resistance and thus survive the selection regimen. Examples of such dominant selection use the drugs neomycin, mycophenolic acid and hygromycin.

Another example of suitable selectable markers for mammalian cells are those that enable the identification of cells competent to take up nucleic acid encoding the antibodies of the present application, such as DHFR, thymidine kinase, metallothionein-I and -II, preferably primate metallothionein genes, adenosine deaminase, ornithine decarboxylase, etc.

For example, cells transformed with the DHFR selection gene are first identified by culturing all of the transformants in a culture medium that contains methotrexate (Mtx), a competitive antagonist of DHFR. An appropriate host cell when wild-type DHFR is employed is the Chinese hamster ovary (CHO) cell line deficient in DHFR activity (e.g., ATCC CRL-9096).

Alternatively, host cells (particularly wild-type hosts that contain endogenous DHFR) transformed or co-transformed with the polypeptide encoding-DNA sequences, wild-type DHFR protein, and another selectable marker such as aminoglycoside 3'-phosphotransferase (APH) can be selected by cell growth in medium containing a selection agent for the selectable marker such as an aminoglycosidic antibiotic, e.g., kanamycin, neomycin, or G418. See U.S. Pat. No. 4,965,199.

d) Promoter Component

Expression and cloning vectors usually contain a promoter that is recognized by the host organism and is operably linked to the nucleic acid encoding the desired polypeptide sequences. Virtually all eukaryotic genes have an AT-rich region located approximately 25 to 30 based upstream from the site where transcription is initiated. Another sequence found 70 to 80 bases upstream from the start of the transcription of many genes is a CNCAAT region where N may be any nucleotide. At the 3' end of most eukaryotic is an AATAAA sequence that may be the signal for addition of the poly A tail to the 3' end of the coding sequence. All of these sequences may be inserted into eukaryotic expression vectors.

Other promoters suitable for use with prokaryotic hosts include the phoA promoter, -lactamase and lactose promoter systems, alkaline phosphatase promoter, a tryptophan (trp) promoter system, and hybrid promoters such as the tac promoter. However, other known bacterial promoters are suitable. Promoters for use in bacterial systems also will contain a Shine-Dalgarno (S.D.) sequence operably linked to the DNA encoding the antibodies.

Polypeptide transcription from vectors in mammalian host cells is controlled, for example, by promoters obtained from the genomes of viruses such as polyoma virus, fowlpox virus, adenovirus (such as Adenovirus 2), bovine papilloma virus, avian sarcoma virus, cytomegalovirus, a retrovirus, hepatitis-B virus and most preferably Simian Virus 40 (SV40), from heterologous mammalian promoters, e.g., the actin promoter or an immunoglobulin promoter, from heat-shock promoters, provided such promoters are compatible with the host cell systems.

The early and late promoters of the SV40 virus are conveniently obtained as an SV40 restriction fragment that also contains the SV40 viral origin of replication. The immediate early promoter of the human cytomegalovirus is conveniently obtained as a HindIII E restriction fragment. A system for expressing DNA in mammalian hosts using the bovine papilloma virus as a vector is disclosed in U.S. Pat. No. 4,419,446. A modification of this system is described in U.S. Pat. No. 4,601,978. See also Reyes et al., *Nature* 297:598-601 (1982) on expression of human-interferon cDNA in mouse cells under the control of a thymidine kinase promoter from herpes simplex virus. Alternatively, the Rous Sarcoma Virus long terminal repeat can be used as the promoter.

e) Enhancer Element Component

Transcription of a DNA encoding the antibodies of the present application by higher eukaryotes is often increased by inserting an enhancer sequence into the vector. Many enhancer sequences are now known from mammalian genes (globin, elastase, albumin, α-fetoprotein, and insulin). Typically, however, one will use an enhancer from a eukaryotic cell virus. Examples include the SV40 enhancer on the late side of the replication origin (100-270 bp), the cytomegalovirus early promoter enhancer, the polyoma enhancer on the late side of the replication origin, and adenovirus enhancers. See also Yaniv, *Nature* 297:17-18 (1982) on enhancing elements for activation of eukaryotic promoters. The enhancer may be spliced into the vector at a position 5' or 3' to the polypeptide encoding sequence, but is preferably located at a site 5' from the promoter.

f) Transcription Termination Component

Expression vectors used in eukaryotic host cells (yeast, fungi, insect, plant, animal, human, or nucleated cells from other multicellular organisms) will also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the polypeptide-encoding mRNA. One useful transcription termination component is the bovine growth hormone polyadenylation region. See WO94/11026 and the expression vector disclosed therein.

g) Selection and Transformation of Host Cells

Suitable host cells for cloning or expressing the DNA in the vectors herein include higher eukaryote cells described herein, including vertebrate host cells. Propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., *J. Gen Virol.* 36:59 (1977)); baby hamster kidney cells (BHK, ATCC CCL 10); Chinese hamster ovary cells/-DHFR (CHO, Urlaub et al., *Proc. Natl. Acad. Sci. USA* 77:4216 (1980)); mouse sertoli cells (TM4, Mather, *Biol. Reprod.* 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TR1 cells (Mather et al., *Annals N.Y. Acad. Sci.* 383:44-68 (1982)); MRC 5 cells; FS4 cells; and a human hepatoma line (Hep G2).

Host cells are transformed with the above-described expression or cloning vectors for antibodies production and cultured in conventional nutrient media modified as appropriate for inducing promoters, selecting transformants, or amplifying the genes encoding the desired sequences.

h) Culturing the Host Cells

The host cells used to produce the antibodies of the present application may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, any of the media described in Ham et al., *Meth. Enz.* 58:44 (1979), Barnes et al., *Anal. Biochem.* 102:255 (1980), U.S. Pat. Nos. 4,767,704; 4,657,866; 4,927,762; 4,560,655; or 5,122,469; WO 90/03430; WO 87/00195; or U.S. Pat. Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

i) Protein Purification

When using recombinant techniques, the antibodies can be produced intracellularly, in the periplasmic space, or directly secreted into the medium. If the antibody is produced intracellularly, as a first step, the particulate debris, either host cells or lysed fragments, are removed, for example, by centrifugation or ultrafiltration. Carter et al., *Bio/Technology* 10:163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The protein composition prepared from the cells can be purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify the antibodies that are based on human immunoglobulins containing 1, 2, or 4 heavy chains (Lindmark et al., *J. Immunol. Meth.* 62:1-13 (1983)). Protein G is recommended for all mouse isotypes and for human 3 (Guss et al., *EMBO J.* 5:15671575 (1986)). The matrix to which the affinity ligand is attached is most often agarose, but other matrices are available. Mechanically stable matrices such as controlled pore glass or poly(styrene-divinyl)benzene allow for faster flow rates and shorter processing times than can be achieved with agarose. Where the antibody comprises a $C_H3$ domain, the Bakerbond ABXTMresin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered.

Following any preliminary purification step(s), the mixture comprising the antibody of interest and contaminants may be subjected to low pH hydrophobic interaction chromatography using an elution buffer at a pH between about 2.5-4.5, preferably performed at low salt concentrations (e.g., from about 0-0.25M salt).

3. Polyclonal Antibodies

Polyclonal antibodies are generally raised in animals by multiple subcutaneous (s.c.) or intraperitoneal (i.p.) injections of the relevant antigen and an adjuvant. It may be useful to conjugate the relevant antigen to a protein that is immunogenic in the species to be immunized, e.g., keyhole limpet hemocyanin (KLH), serum albumin, bovine thyroglobulin, or soybean trypsin inhibitor, using a bifunctional or derivatizing agent, e.g., maleimidobenzoyl sulfosuccinimide ester (conjugation through cysteine residues), N-hydroxysuccinimide (through lysine residues), glutaraldehyde, succinic anhydride, $SOCl_2$, or $R^1N=C=NR$, where R and $R^1$ are independently lower alkyl groups. Examples of adjuvants which may be employed include Freund's complete adjuvant and MPL-TDM adjuvant (monophosphoryl Lipid A, synthetic trehalose dicorynomycolate). The immunization protocol may be selected by one skilled in the art without undue experimentation.

The animals are immunized against the antigen, immunogenic conjugates, or derivatives by combining, e.g., 100 µg or 5 µg or the protein or conjugate (for rabbits or mice, respectively) with 3 volumes of Freund's complete adjuvant and injecting the solution intradermally at multiple sites. One month later, the animals are boosted with ⅕ to ⅒ the original amount of peptide or conjugate in Freund's complete adjuvant by subcutaneous injection at multiple sites. Seven to fourteen days later, the animals are bled and the serum is assayed for antibody titer. Animals are boosted until the titer plateaus. Conjugates also can be made in recombinant cell culture as protein fusions. Also, aggregating agents such as alum are suitable to enhance the immune response.

4. Monoclonal Antibodies

Monoclonal antibodies are obtained from a population of substantially homogeneous antibodies, i.e., the individual antibodies comprising the population are identical except for possible naturally occurring mutations and/or post-translational modifications (e.g., isomerizations, amidations) that may be present in minor amounts. Thus, the modifier "monoclonal" indicates the character of the antibody as not being a mixture of discrete antibodies.

For example, the monoclonal antibodies may be made using the hybridoma method first described by Kohler et al., *Nature*, 256:495 (1975), or may be made by recombinant DNA methods (U.S. Pat. No. 4,816,567).

In the hybridoma method, a mouse or other appropriate host animal, such as a hamster or a llama, is immunized as hereinabove described to elicit lymphocytes that produce or are capable of producing antibodies that will specifically bind the protein used for immunization. Alternatively, lymphocytes may be immunized in vitro. Lymphocytes then are fused with myeloma cells using a suitable fusing agent, such as polyethylene glycol, to form a hybridoma cell (Goding, *Monoclonal Antibodies: Principles and Practice*, pp. 59-103 (Academic Press, 1986).

The immunizing agent will typically include the antigenic protein or a fusion variant thereof. Generally either peripheral blood lymphocytes ("PBLs") are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell. Goding, *Monoclonal Antibodies: Principles and Practice*, Academic Press (1986), pp. 59-103.

Immortalized cell lines are usually transformed mammalian cells, particularly myeloma cells of rodent, bovine and human origin. Usually, rat or mouse myeloma cell lines are employed. The hybridoma cells thus prepared are seeded and grown in a suitable culture medium that preferably contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which are substances that prevent the growth of HGPRT-deficient cells.

Preferred immortalized myeloma cells are those that fuse efficiently, support stable high-level production of antibody by the selected antibody-producing cells, and are sensitive to a medium such as HAT medium. Among these, preferred are murine myeloma lines, such as those derived from MOPC-21 and MPC-11 mouse tumors available from the Salk Institute Cell Distribution Center, San Diego, Calif. USA, and SP-2 cells (and derivatives thereof, e.g., X63-Ag8-653) available from the American Type Culture Collection, Manassas, Va. USA. Human myeloma and mouse-human heteromyeloma cell lines also have been described for the production of human monoclonal antibodies (Kozbor, *J. Immunol.*, 133:3001 (1984); Brodeur et al., *Monoclonal Antibody Production Techniques and Applications*, pp. 51-63 (Marcel Dekker, Inc., New York, 1987)).

Culture medium in which hybridoma cells are growing is assayed for production of monoclonal antibodies directed against the antigen. Preferably, the binding specificity of monoclonal antibodies produced by hybridoma cells is determined by immunoprecipitation or by an in vitro binding assay, such as radioimmunoassay (RIA) or enzyme-linked immunosorbent assay (ELISA).

The culture medium in which the hybridoma cells are cultured can be assayed for the presence of monoclonal antibodies directed against the desired antigen. Preferably, the binding affinity and specificity of the monoclonal antibody can be determined by immunoprecipitation or by an in vitro binding assay, such as radioimmunoassay (RIA) or enzyme-linked assay (ELISA). Such techniques and assays are known in the in art. For example, binding affinity may be determined by the Scatchard analysis of Munson et al., *Anal. Biochem.*, 107:220 (1980).

After hybridoma cells are identified that produce antibodies of the desired specificity, affinity, and/or activity, the clones may be subcloned by limiting dilution procedures and grown by standard methods (Goding, supra). Suitable culture media for this purpose include, for example, D-MEM or RPMI-1640 medium. In addition, the hybridoma cells may be grown in vivo as tumors in a mammal.

The monoclonal antibodies secreted by the subclones are suitably separated from the culture medium, ascites fluid, or serum by conventional immunoglobulin purification procedures such as, for example, protein A-Sepharose, hydroxylapatite chromatography, gel electrophoresis, dialysis, or affinity chromatography.

Monoclonal antibodies may also be made by recombinant DNA methods, such as those described in U.S. Pat. No. 4,816,567, and as described above. DNA encoding the monoclonal antibodies is readily isolated and sequenced using conventional procedures (e.g., by using oligonucleotide probes that are capable of binding specifically to genes encoding the heavy and light chains of murine antibodies). The hybridoma cells serve as a preferred source of such DNA. Once isolated, the DNA may be placed into expression vectors, which are then transfected into host cells such as E. coli cells, simian COS cells, Chinese hamster ovary (CHO) cells, or myeloma cells that do not otherwise produce immunoglobulin protein, in order to synthesize monoclonal antibodies in such recombinant host cells. Review articles on recombinant expression in bacteria of DNA encoding the antibody include Skerra et al., Curr. Opinion in Immunol., 5:256-262 (1993) and Pliickthun, Immunol. Revs. 130:151-188 (1992).

In a further embodiment, antibodies can be isolated from antibody phage libraries generated using the techniques described in McCafferty et al., Nature, 348:552-554 (1990). Clackson et al., Nature, 352:624-628 (1991) and Marks et al., J. Mol. Biol., 222:581-597 (1991) describe the isolation of murine and human antibodies, respectively, using phage libraries. Subsequent publications describe the production of high affinity (nM range) human antibodies by chain shuffling (Marks et al., Bio/Technology, 10:779-783 (1992)), as well as combinatorial infection and in vivo recombination as a strategy for constructing very large phage libraries (Waterhouse et al., Nucl. Acids Res., 21:2265-2266 (1993)). Thus, these techniques are viable alternatives to traditional monoclonal antibody hybridoma techniques for isolation of monoclonal antibodies.

The DNA also may be modified, for example, by substituting the coding sequence for human heavy- and light-chain constant domains in place of the homologous murine sequences (U.S. Pat. No. 4,816,567; Morrison, et al., Proc. Natl Acad. Sci. USA, 81:6851 (1984)), or by covalently joining to the immunoglobulin coding sequence all or part of the coding sequence for a non-immunoglobulin polypeptide. Typically such non-immunoglobulin polypeptides are substituted for the constant domains of an antibody, or they are substituted for the variable domains of one antigen-combining site of an antibody to create a chimeric bivalent antibody comprising one antigen-combining site having specificity for an antigen and another antigen-combining site having specificity for a different antigen.

The monoclonal antibodies described herein may by monovalent, the preparation of which is well known in the art. For example, one method involves recombinant expression of immunoglobulin light chain and a modified heavy chain. The heavy chain is truncated generally at any point in the Fc region so as to prevent heavy chain crosslinking. Alternatively, the relevant cysteine residues may be substituted with another amino acid residue or are deleted so as to prevent crosslinking. In vitro methods are also suitable for preparing monovalent antibodies. Digestion of antibodies to produce fragments thereof, particularly Fab fragments, can be accomplished using routine techniques known in the art.

Chimeric or hybrid antibodies also may be prepared in vitro using known methods in synthetic protein chemistry, including those involving crosslinking agents. For example, immunotoxins may be constructed using a disulfide-exchange reaction or by forming a thioether bond. Examples of suitable reagents for this purpose include iminothiolate and methyl-4-mercaptobutyrimidate.

Also, see, Example 1 for monoclonal sdAb production.

5. Humanized and Human Antibodies

Humanized antibodies include human immunoglobulins (recipient antibody) in which residues from a CDR of the recipient are replaced by residues from a CDR of a non-human species (donor antibody) such as mouse, rat, rabbit, camelid, or llama having the desired specificity, affinity, and capacity. In some instances, Fv framework residues of the human immunoglobulin are replaced by corresponding non-human residues. Humanized antibodies can also comprise residues that are found neither in the recipient antibody nor in the imported CDR or framework sequences. In general, the humanized antibody can comprise substantially all of at least one, and typically two, variable domains, in which all or substantially all of the CDR regions correspond to those of a non-human immunoglobulin, and all or substantially all of the FR regions are those of a human immunoglobulin consensus sequence. In some embodiments, the humanized antibody will comprise at least a portion of an immunoglobulin constant region (Fc), typically that of a human immunoglobulin. See, e.g., Jones et al., Nature, 321: 522-525 (1986); Riechmann et al., Nature, 332: 323-329 (1988); Presta, Curr. Op. Struct. Biol., 2:593-596 (1992).

Generally, a humanized antibody has one or more amino acid residues introduced into it from a source that is non-human. These non-human amino acid residues are often referred to as "import" residues, which are typically taken from an "import" variable domain. According to some embodiments, humanization can be essentially performed following the method of Winter and co-workers (Jones et al., Nature, 321: 522-525 (1986); Riechmann et al., Nature, 332: 323-327 (1988); Verhoeyen et al., Science, 239: 1534-1536 (1988)), by substituting rodent CDRs or CDR sequences for the corresponding sequences of a human antibody. Accordingly, such "humanized" antibodies are antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in non-human antibodies (such as llama $V_H H$ domain).

As an alternative to humanization, human antibodies can be generated. For example, it is now possible to produce transgenic animals (e.g., mice) that are capable, upon immunization, of producing a full repertoire of human antibodies in the absence of endogenous immunoglobulin production. For example, it has been described that the homozygous deletion of the antibody heavy-chain joining region (JH) gene in chimeric and germ-line mutant mice results in complete inhibition of endogenous antibody production. Transfer of the human germ-line immunoglobulin gene array into such germ-line mutant mice will result in the production of human antibodies upon antigen challenge. See, e.g., Jakobovits et al., PNAS USA, 90:2551 (1993); Jakobovits et al., Nature, 362:255-258 (1993); Bruggemann et al., Year in Immunol., 7:33 (1993); U.S. Pat. Nos. 5,545,806, 5,569,825, 5,591,669; 5,545,807; and WO 97/17852. Alternatively, human antibodies can be made by introducing human immunoglobulin loci into transgenic animals, e.g., mice in which the endogenous immunoglobulin genes have been partially or completely inactivated. Upon challenge, human antibody production is observed that closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; and 5,661,016, and Marks et al., *Bio/Technology*, 10: 779-783 (1992); Lonberg et al., *Nature*, 368: 856-859 (1994); Morrison, *Nature*, 368: 812-813 (1994); Fishwild et al., *Nature Biotechnology*, 14: 845-851 (1996); Neuberger, *Nature Biotechnology*, 14: 826 (1996); Lonberg and Huszar, *Intern. Rev. Immunol.*, 13: 65-93 (1995).

Human antibodies may also be generated by in vitro activated B cells (see U.S. Pat. Nos. 5,567,610 and 5,229,275) or by using various techniques known in the art, including phage display libraries. Hoogenboom and Winter, *J. Mol. Biol.*, 227:381 (1991); Marks et al., *J. Mol. Biol.*, 222:581 (1991). The techniques of Cole et al. and Boerner et al. are also available for the preparation of human monoclonal antibodies. Cole et al., *Monoclonal Antibodies and Cancer Therapy*, Alan R. Liss, p. 77 (1985) and Boerner et al., *J Immunol.*, 147(1): 86-95 (1991).

VI. Articles of Manufacture and Kits

Further provided are kits and articles of manufacture comprising any of the isolated anti-CTLA-4 constructs (such as anti-CTLA-4 sdAb, anti-CTLA-4 HCAb, CTLA-4×PD-1 bispecific construct (e.g., BABP), CTLA-4×PD-L1 bispecific construct (e.g., BABP)), isolated nucleic acids or vectors encoding thereof, or isolated host cells comprising the isolated nucleic acids or vectors encoding the anti-CTLA-4 constructs. In some embodiments, a kit is provided which comprises any one of the pharmaceutical compositions described herein and preferably provides instructions for its use.

The kits of the present application are in suitable packaging. Suitable packaging includes, but is not limited to, vials, bottles, jars, flexible packaging (e.g., sealed Mylar or plastic bags), and the like. Kits may optionally provide additional components such as buffers and interpretative information. The present application thus also provides articles of manufacture, which include vials (such as sealed vials), bottles, jars, flexible packaging, and the like.

The article of manufacture can comprise a container and a label or package insert on or associated with the container. Suitable containers include, for example, bottles, vials, syringes, etc. The containers may be formed from a variety of materials such as glass or plastic. Generally, the container holds a composition which is effective for treating a disease or disorder (such as cancer) described herein, and may have a sterile access port (for example the container may be an intravenous solution bag or a vial having a stopper pierceable by a hypodermic injection needle). The label or package insert indicates that the composition is used for treating the particular condition in an individual. The label or package insert will further comprise instructions for administering the composition to the individual. The label may indicate directions for reconstitution and/or use. The container holding the pharmaceutical composition may be a multi-use vial, which allows for repeat administrations (e.g. from 2-6 administrations) of the reconstituted formulation. Package insert refers to instructions customarily included in commercial packages of therapeutic products that contain information about the indications, usage, dosage, administration, contraindications and/or warnings concerning the use of such therapeutic products. Additionally, the article of manufacture may further comprise a second container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

The kits or article of manufacture may include multiple unit doses of the pharmaceutical composition and instructions for use, packaged in quantities sufficient for storage and use in pharmacies, for example, hospital pharmacies and compounding pharmacies.

EXEMPLARY EMBODIMENTS

Embodiment 1

An isolated anti-CTLA-4 construct comprising a single-domain antibody (sdAb) moiety specifically recognizing CTLA-4, wherein the sdAb moiety comprises a CDR1 comprising the amino acid sequence of any one of SEQ ID NOs: 17-32 and 213-222, or a variant thereof comprising up to about 3 amino acid substitutions; a CDR2 comprising the amino acid sequence of any one of SEQ ID NOs: 49-64, 233-242, and 339, or a variant thereof comprising up to about 3 amino acid substitutions; and a CDR3 comprising the amino acid sequence of any one of SEQ ID NOs: 81-96 and 253-262, or a variant thereof comprising up to about 3 amino acid substitutions.

Embodiment 2

The isolated anti-CTLA-4 construct of embodiment 1, wherein the sdAb moiety comprises a CDR1 comprising the amino acid sequence of any one of SEQ ID NOs: 17-32 and 213-222; a CDR2 comprising the amino acid sequence of any one of SEQ ID NOs: 49-64, 233-242, and 339; and a CDR3 comprising the amino acid sequence of any one of SEQ ID NOs: 81-96 and 253-262; or a variant thereof comprising up to about 3 amino acid substitutions in the CDR regions.

Embodiment 3

The isolated anti-CTLA-4 construct of embodiment 1 or 2, wherein the sdAb moiety comprises any one of the following:

(1) a CDR1 comprising the amino acid sequence of SEQ ID NO: 17, or a variant thereof comprising up to about 3 amino acid substitutions; a CDR2 comprising the amino acid sequence of SEQ ID NO: 49, or a variant thereof comprising up to about 3 amino acid substitutions; and a CDR3 comprising the amino acid sequence of SEQ ID NO: 81, or a variant thereof comprising up to about 3 amino acid substitutions;

(2) a CDR1 comprising the amino acid sequence of SEQ ID NO: 18, or a variant thereof comprising up to about 3 amino acid substitutions; a CDR2 comprising the amino acid sequence of SEQ ID NO: 50, or a variant thereof comprising up to about 3 amino acid substitutions; and a CDR3 comprising the amino acid sequence of SEQ ID NO: 82, or a variant thereof comprising up to about 3 amino acid substitutions;

(3) a CDR1 comprising the amino acid sequence of SEQ ID NO: 19, or a variant thereof comprising up to about 3 amino acid substitutions; a CDR2 comprising the amino acid sequence of SEQ ID NO: 51, or a variant thereof comprising up to about 3 amino acid substitutions; and a CDR3 comprising the amino acid sequence of SEQ ID NO: 83, or a variant thereof comprising up to about 3 amino acid substitutions;

(4) a CDR1 comprising the amino acid sequence of SEQ ID NO: 20, or a variant thereof comprising up to about 3 amino acid substitutions; a CDR2 comprising the amino acid sequence of SEQ ID NO: 52, or a variant thereof comprising up to about 3 amino acid substitutions; and a CDR3 comprising the amino acid sequence of SEQ ID NO: 84, or a variant thereof comprising up to about 3 amino acid substitutions;

(5) a CDR1 comprising the amino acid sequence of SEQ ID NO: 21, or a variant thereof comprising up to about 3 amino acid substitutions; a CDR2 comprising the amino acid sequence of SEQ ID NO: 53, or a variant thereof comprising up to about 3 amino acid substitutions; and a CDR3 comprising the amino acid sequence of SEQ ID NO: 85, or a variant thereof comprising up to about 3 amino acid substitutions;

(6) a CDR1 comprising the amino acid sequence of SEQ ID NO: 22, or a variant thereof comprising up to about 3 amino acid substitutions; a CDR2 comprising the amino acid sequence of SEQ ID NO: 54, or a variant thereof comprising up to about 3 amino acid substitutions; and a CDR3 comprising the amino acid sequence of SEQ ID NO: 86, or a variant thereof comprising up to about 3 amino acid substitutions;

(7) a CDR1 comprising the amino acid sequence of SEQ ID NO: 23, or a variant thereof comprising up to about 3 amino acid substitutions; a CDR2 comprising the amino acid sequence of SEQ ID NO: 55, or a variant thereof comprising up to about 3 amino acid substitutions; and a CDR3 comprising the amino acid sequence of SEQ ID NO: 87, or a variant thereof comprising up to about 3 amino acid substitutions;

(8) a CDR1 comprising the amino acid sequence of SEQ ID NO: 24, or a variant thereof comprising up to about 3 amino acid substitutions; a CDR2 comprising the amino acid sequence of SEQ ID NO: 56, or a variant thereof comprising up to about 3 amino acid substitutions; and a CDR3 comprising the amino acid sequence of SEQ ID NO: 88, or a variant thereof comprising up to about 3 amino acid substitutions;

(9) a CDR1 comprising the amino acid sequence of SEQ ID NO: 25, or a variant thereof comprising up to about 3 amino acid substitutions; a CDR2 comprising the amino acid sequence of SEQ ID NO: 57, or a variant thereof comprising up to about 3 amino acid substitutions; and a CDR3 comprising the amino acid sequence of SEQ ID NO: 89, or a variant thereof comprising up to about 3 amino acid substitutions;

(10) a CDR1 comprising the amino acid sequence of SEQ ID NO: 26, or a variant thereof comprising up to about 3 amino acid substitutions; a CDR2 comprising the amino acid sequence of SEQ ID NO: 58, or a variant thereof comprising up to about 3 amino acid substitutions; and a CDR3 comprising the amino acid sequence of SEQ ID NO: 90, or a variant thereof comprising up to about 3 amino acid substitutions;

(11) a CDR1 comprising the amino acid sequence of SEQ ID NO: 27, or a variant thereof comprising up to about 3 amino acid substitutions; a CDR2 comprising the amino acid sequence of SEQ ID NO: 59, or a variant thereof comprising up to about 3 amino acid substitutions; and a CDR3 comprising the amino acid sequence of SEQ ID NO: 91, or a variant thereof comprising up to about 3 amino acid substitutions;

(12) a CDR1 comprising the amino acid sequence of SEQ ID NO: 28, or a variant thereof comprising up to about 3 amino acid substitutions; a CDR2 comprising the amino acid sequence of SEQ ID NO: 60, or a variant thereof comprising up to about 3 amino acid substitutions; and a CDR3 comprising the amino acid sequence of SEQ ID NO: 92, or a variant thereof comprising up to about 3 amino acid substitutions;

(13) a CDR1 comprising the amino acid sequence of SEQ ID NO: 29, or a variant thereof comprising up to about 3 amino acid substitutions; a CDR2 comprising the amino acid sequence of SEQ ID NO: 61, or a variant thereof comprising up to about 3 amino acid substitutions; and a CDR3 comprising the amino acid sequence of SEQ ID NO: 93, or a variant thereof comprising up to about 3 amino acid substitutions;

(14) a CDR1 comprising the amino acid sequence of SEQ ID NO: 30, or a variant thereof comprising up to about 3 amino acid substitutions; a CDR2 comprising the amino acid sequence of SEQ ID NO: 62, or a variant thereof comprising up to about 3 amino acid substitutions; and a CDR3 comprising the amino acid sequence of SEQ ID NO: 94, or a variant thereof comprising up to about 3 amino acid substitutions;

(15) a CDR1 comprising the amino acid sequence of SEQ ID NO: 31, or a variant thereof comprising up to about 3 amino acid substitutions; a CDR2 comprising the amino acid sequence of SEQ ID NO: 63, or a variant thereof comprising up to about 3 amino acid substitutions; and a CDR3 comprising the amino acid sequence of SEQ ID NO: 95, or a variant thereof comprising up to about 3 amino acid substitutions;

(16) a CDR1 comprising the amino acid sequence of SEQ ID NO: 32, or a variant thereof comprising up to about 3 amino acid substitutions; a CDR2 comprising the amino acid sequence of SEQ ID NO: 64, or a variant thereof comprising up to about 3 amino acid substitutions; and a CDR3 comprising the amino acid sequence of SEQ ID NO: 96, or a variant thereof comprising up to about 3 amino acid substitutions;

(17) a CDR1 comprising the amino acid sequence of SEQ ID NO: 213, or a variant thereof comprising up to about 3 amino acid substitutions; a CDR2 comprising the amino acid sequence of SEQ ID NO: 233, or a variant thereof comprising up to about 3 amino acid substitutions; and a CDR3 comprising the amino acid sequence of SEQ ID NO: 253, or a variant thereof comprising up to about 3 amino acid substitutions;

(18) a CDR1 comprising the amino acid sequence of SEQ ID NO: 214, or a variant thereof comprising up to about 3 amino acid substitutions; a CDR2 comprising the amino acid sequence of SEQ ID NO: 234, or a variant thereof comprising up to about 3 amino acid substitutions; and a CDR3 comprising the amino acid sequence of SEQ ID NO: 254, or a variant thereof comprising up to about 3 amino acid substitutions;

(19) a CDR1 comprising the amino acid sequence of SEQ ID NO: 215, or a variant thereof comprising up to about 3 amino acid substitutions; a CDR2 comprising the amino acid sequence of SEQ ID NO: 235, or a variant thereof comprising up to about 3 amino acid substitutions; and a CDR3 comprising the amino acid sequence of SEQ ID NO: 255, or a variant thereof comprising up to about 3 amino acid substitutions;

(20) a CDR1 comprising the amino acid sequence of SEQ ID NO: 216, or a variant thereof comprising up to about 3 amino acid substitutions; a CDR2 comprising the amino acid sequence of SEQ ID NO: 236, or a variant thereof comprising up to about 3 amino acid substitutions; and a CDR3 comprising the amino acid sequence of SEQ ID NO: 256, or a variant thereof comprising up to about 3 amino acid substitutions;

(21) a CDR1 comprising the amino acid sequence of SEQ ID NO: 217, or a variant thereof comprising up to about 3 amino acid substitutions; a CDR2 comprising the amino acid sequence of SEQ ID NO: 237, or a variant thereof comprising up to about 3 amino acid substitutions; and a CDR3 comprising the amino acid sequence of SEQ ID NO: 257, or a variant thereof comprising up to about 3 amino acid substitutions;

(22) a CDR1 comprising the amino acid sequence of SEQ ID NO: 218, or a variant thereof comprising up to about 3 amino acid substitutions; a CDR2 comprising the amino acid sequence of SEQ ID NO: 238, or a variant thereof comprising up to about 3 amino acid substitutions; and a CDR3 comprising the amino acid sequence of SEQ ID NO: 258, or a variant thereof comprising up to about 3 amino acid substitutions;

(23) a CDR1 comprising the amino acid sequence of SEQ ID NO: 219, or a variant thereof comprising up to about 3 amino acid substitutions; a CDR2 comprising the amino acid sequence of SEQ ID NO: 239, or a variant thereof comprising up to about 3 amino acid substitutions; and a CDR3 comprising the amino acid sequence of SEQ ID NO: 259, or a variant thereof comprising up to about 3 amino acid substitutions;

(24) a CDR1 comprising the amino acid sequence of SEQ ID NO: 220, or a variant thereof comprising up to about 3 amino acid substitutions; a CDR2 comprising the amino acid sequence of SEQ ID NO: 240, or a variant thereof comprising up to about 3 amino acid substitutions; and a CDR3 comprising the amino acid sequence of SEQ ID NO: 260, or a variant thereof comprising up to about 3 amino acid substitutions;

(25) a CDR1 comprising the amino acid sequence of SEQ ID NO: 221, or a variant thereof comprising up to about 3 amino acid substitutions; a CDR2 comprising the amino acid sequence of SEQ ID NO: 241, or a variant thereof comprising up to about 3 amino acid substitutions; and a CDR3 comprising the amino acid sequence of SEQ ID NO: 261, or a variant thereof comprising up to about 3 amino acid substitutions;

(26) a CDR1 comprising the amino acid sequence of SEQ ID NO: 222, or a variant thereof comprising up to about 3 amino acid substitutions; a CDR2 comprising the amino acid sequence of SEQ ID NO: 242, or a variant thereof comprising up to about 3 amino acid substitutions; and a CDR3 comprising the amino acid sequence of SEQ ID NO: 262, or a variant thereof comprising up to about 3 amino acid substitutions; or

(27) a CDR1 comprising the amino acid sequence of SEQ ID NO: 214, or a variant thereof comprising up to about 3 amino acid substitutions; a CDR2 comprising the amino acid sequence of SEQ ID NO: 339, or a variant thereof comprising up to about 3 amino acid substitutions; and a CDR3 comprising the amino acid sequence of SEQ ID NO: 254, or a variant thereof comprising up to about 3 amino acid substitutions.

Embodiment 4

The isolated anti-CTLA-4 construct of any one of embodiments 1-3, wherein the sdAb moiety comprises any one of the following:

(1) a CDR1 comprising the amino acid sequence of SEQ ID NO: 17; a CDR2 comprising the amino acid sequence of SEQ ID NO: 49; and a CDR3 comprising the amino acid sequence of SEQ ID NO: 81; or a variant thereof comprising up to about 3 amino acid substitutions in the CDR regions;

(2) a CDR1 comprising the amino acid sequence of SEQ ID NO: 18; a CDR2 comprising the amino acid sequence of SEQ ID NO: 50; and a CDR3 comprising the amino acid sequence of SEQ ID NO: 82; or a variant thereof comprising up to about 3 amino acid substitutions in the CDR regions;

(3) a CDR1 comprising the amino acid sequence of SEQ ID NO: 19; a CDR2 comprising the amino acid sequence of SEQ ID NO: 51; and a CDR3 comprising the amino acid sequence of SEQ ID NO: 83; or a variant thereof comprising up to about 3 amino acid substitutions in the CDR regions;

(4) a CDR1 comprising the amino acid sequence of SEQ ID NO: 20; a CDR2 comprising the amino acid sequence of SEQ ID NO: 52; and a CDR3 comprising the amino acid sequence of SEQ ID NO: 84; or a variant thereof comprising up to about 3 amino acid substitutions in the CDR regions;

(5) a CDR1 comprising the amino acid sequence of SEQ ID NO: 21; a CDR2 comprising the amino acid sequence of SEQ ID NO: 53; and a CDR3 comprising the amino acid sequence of SEQ ID NO: 85; or a variant thereof comprising up to about 3 amino acid substitutions in the CDR regions;

(6) a CDR1 comprising the amino acid sequence of SEQ ID NO: 22; a CDR2 comprising the amino acid sequence of SEQ ID NO: 54; and a CDR3 comprising the amino acid sequence of SEQ ID NO: 86; or a variant thereof comprising up to about 3 amino acid substitutions in the CDR regions;

(7) a CDR1 comprising the amino acid sequence of SEQ ID NO: 23; a CDR2 comprising the amino acid sequence of SEQ ID NO: 55; and a CDR3 comprising the amino acid sequence of SEQ ID NO: 87; or a variant thereof comprising up to about 3 amino acid substitutions in the CDR regions;

(8) a CDR1 comprising the amino acid sequence of SEQ ID NO: 24; a CDR2 comprising the amino acid sequence of SEQ ID NO: 56; and a CDR3 comprising the amino acid sequence of SEQ ID NO: 88; or a variant thereof comprising up to about 3 amino acid substitutions in the CDR regions;

(9) a CDR1 comprising the amino acid sequence of SEQ ID NO: 25; a CDR2 comprising the amino acid sequence of SEQ ID NO: 57; and a CDR3 comprising the amino acid sequence of SEQ ID NO: 89; or a variant thereof comprising up to about 3 amino acid substitutions in the CDR regions;

(10) a CDR1 comprising the amino acid sequence of SEQ ID NO: 26; a CDR2 comprising the amino acid sequence of SEQ ID NO: 58; and a CDR3 comprising the amino acid sequence of SEQ ID NO: 90; or a variant thereof comprising up to about 3 amino acid substitutions in the CDR regions;

(11) a CDR1 comprising the amino acid sequence of SEQ ID NO: 27; a CDR2 comprising the amino acid sequence of SEQ ID NO: 59; and a CDR3 comprising the amino acid sequence of SEQ ID NO: 91; or a variant thereof comprising up to about 3 amino acid substitutions in the CDR regions;

(12) a CDR1 comprising the amino acid sequence of SEQ ID NO: 28; a CDR2 comprising the amino acid sequence of SEQ ID NO: 60; and a CDR3 comprising the amino acid sequence of SEQ ID NO: 92; or a variant thereof comprising up to about 3 amino acid substitutions in the CDR regions;

(13) a CDR1 comprising the amino acid sequence of SEQ ID NO: 29; a CDR2 comprising the amino acid sequence of SEQ ID NO: 61; and a CDR3 comprising the amino acid sequence of SEQ ID NO: 93; or a variant thereof comprising up to about 3 amino acid substitutions in the CDR regions;

(14) a CDR1 comprising the amino acid sequence of SEQ ID NO: 30; a CDR2 comprising the amino acid sequence of SEQ ID NO: 62; and a CDR3 comprising the amino acid sequence of SEQ ID NO: 94; or a variant thereof comprising up to about 3 amino acid substitutions in the CDR regions;

(15) a CDR1 comprising the amino acid sequence of SEQ ID NO: 31; a CDR2 comprising the amino acid sequence of SEQ ID NO: 63; and a CDR3 comprising the amino acid sequence of SEQ ID NO: 95; or a variant thereof comprising up to about 3 amino acid substitutions in the CDR regions;

(16) a CDR1 comprising the amino acid sequence of SEQ ID NO: 32; a CDR2 comprising the amino acid sequence of SEQ ID NO: 64; and a CDR3 comprising the amino acid sequence of SEQ ID NO: 96; or a variant thereof comprising up to about 3 amino acid substitutions in the CDR regions;

(17) a CDR1 comprising the amino acid sequence of SEQ ID NO: 213; a CDR2 comprising the amino acid sequence of SEQ ID NO: 233; and a CDR3 comprising the amino acid sequence of SEQ ID NO: 253; or a variant thereof comprising up to about 3 (such as about any of 1, 2, or 3) amino acid substitutions in the CDR regions;

(18) a CDR1 comprising the amino acid sequence of SEQ ID NO: 214; a CDR2 comprising the amino acid sequence of SEQ ID NO: 234; and a CDR3 comprising the amino acid sequence of SEQ ID NO: 254; or a variant thereof comprising up to about 3 (such as about any of 1, 2, or 3) amino acid substitutions in the CDR regions;

(19) a CDR1 comprising the amino acid sequence of SEQ ID NO: 215; a CDR2 comprising the amino acid sequence of SEQ ID NO: 235; and a CDR3 comprising the amino acid sequence of SEQ ID NO: 255; or a variant thereof comprising up to about 3 (such as about any of 1, 2, or 3) amino acid substitutions in the CDR regions;

(20) a CDR1 comprising the amino acid sequence of SEQ ID NO: 216; a CDR2 comprising the amino acid sequence of SEQ ID NO: 236; and a CDR3 comprising the amino acid sequence of SEQ ID NO: 256; or a variant thereof comprising up to about 3 (such as about any of 1, 2, or 3) amino acid substitutions in the CDR regions;

(21) a CDR1 comprising the amino acid sequence of SEQ ID NO: 217; a CDR2 comprising the amino acid sequence of SEQ ID NO: 237; and a CDR3 comprising the amino acid sequence of SEQ ID NO: 257; or a variant thereof comprising up to about 3 (such as about any of 1, 2, or 3) amino acid substitutions in the CDR regions;

(22) a CDR1 comprising the amino acid sequence of SEQ ID NO: 218; a CDR2 comprising the amino acid sequence of SEQ ID NO: 238; and a CDR3 comprising the amino acid sequence of SEQ ID NO: 258; or a variant thereof comprising up to about 3 (such as about any of 1, 2, or 3) amino acid substitutions in the CDR regions;

(23) a CDR1 comprising the amino acid sequence of SEQ ID NO: 219; a CDR2 comprising the amino acid sequence of SEQ ID NO: 239; and a CDR3 comprising the amino acid sequence of SEQ ID NO: 259; or a variant thereof comprising up to about 3 (such as about any of 1, 2, or 3) amino acid substitutions in the CDR regions;

(24) a CDR1 comprising the amino acid sequence of SEQ ID NO: 220; a CDR2 comprising the amino acid sequence of SEQ ID NO: 240; and a CDR3 comprising the amino acid sequence of SEQ ID NO: 260; or a variant thereof comprising up to about 3 (such as about any of 1, 2, or 3) amino acid substitutions in the CDR regions;

(25) a CDR1 comprising the amino acid sequence of SEQ ID NO: 221; a CDR2 comprising the amino acid sequence of SEQ ID NO: 241; and a CDR3 comprising the amino acid sequence of SEQ ID NO: 261; or a variant thereof comprising up to about 3 (such as about any of 1, 2, or 3) amino acid substitutions in the CDR regions;

(26) a CDR1 comprising the amino acid sequence of SEQ ID NO: 222; a CDR2 comprising the amino acid sequence of SEQ ID NO: 242; and a CDR3 comprising the amino acid sequence of SEQ ID NO: 262; or a variant thereof comprising up to about 3 (such as about any of 1, 2, or 3) amino acid substitutions in the CDR regions; or

(27) a CDR1 comprising the amino acid sequence of SEQ ID NO: 214; a CDR2 comprising the amino acid sequence of SEQ ID NO: 339; and a CDR3 comprising the amino acid sequence of SEQ ID NO: 254; or a variant thereof comprising up to about 3 (such as about any of 1, 2, or 3) amino acid substitutions in the CDR regions.

Embodiment 5

The isolated anti-CTLA-4 construct of any one of embodiments 1-4, wherein the sdAb moiety comprises a $V_H H$ domain comprising the amino acid sequence of any one of the following:

a-1) the amino acid residue at position 37 is selected from the group consisting of F, Y, V, L, A, H, S, I, W, C, N, G, D, T, and P;

a-2) the amino acid residue at position 44 is selected from the group consisting of E, Q, G, D, A, K, R, L, P, S, V, H, T, N, W, M, and I;

a-3) the amino acid residue at position 45 is selected from the group consisting of L, R, P, H, F, G, Q, S, E, T, Y, C, I, D, and V;

a-4) the amino acid residue at position 103 is selected from the group consisting of W, R, G, S, K, A, M, Y, I, F, T, N, V, Q, P, E, and C; and a-5) the amino acid residue at position 108 is selected from the group consisting of Q, L, R, P, E, K, S, T, M, A, and H; or b-1) the amino acid residue at position 37 is selected from the group consisting of F, Y, L, I, and V;

b-2) the amino acid residue at position 44 is selected from the group consisting of E and Q;

b-3) the amino acid residue at position 45 is selected from the group consisting of R and L;
b-4) the amino acid residue at position 103 is selected from the group consisting of W, R, G, and S; and
b-5) the amino acid residue at position 108 is selected from the group consisting of Q and L; or
c-1) the amino acid residue at position 37 is selected from the group consisting of F, Y, L, I, and V;
c-2) the amino acid residue at position 44 is selected from the group consisting of A, G, E, D, Q, R, S and L;
c-3) the amino acid residue at position 45 is selected from the group consisting of L, R and C;
c-4) the amino acid residue at position 103 is selected from the group consisting of P, R and S; and
c-5) the amino acid residue at position 108 is selected from the group consisting of Q and L;
wherein the amino acid position is according to Kabat numbering, and wherein position 108 can be optionally humanized to L when position 108 is Q.

Embodiment 6

The isolated anti-CTLA-4 construct of embodiment 5, wherein the sdAb moiety comprises a $V_HH$ domain comprising the amino acid sequence of any one of the following:
a-1) the amino acid residue at position 37 is selected from the group consisting of F, Y, L, I, and V;
a-2) the amino acid residue at position 44 is selected from the group consisting of A, G, E, D, Q, R, S, and L;
a-3) the amino acid residue at position 45 is selected from the group consisting of L, C, and R;
a-4) the amino acid residue at position 103 is selected from the group consisting of W, G, and R; and
a-5) the amino acid residue at position 108 is Q; or
b-1) the amino acid residue at position 37 is selected from the group consisting of F and Y;
b-2) the amino acid residue at position 44 is selected from the group consisting of E and Q;
b-3) the amino acid residue at position 45 is selected from the group consisting of R and L;
b-4) the amino acid residue at position 103 is W; and
b-5) the amino acid residue at position 108 is Q; or
c-1) the amino acid residue at position 37 is selected from the group consisting of F and Y;
c-2) the amino acid residue at position 44 is selected from the group consisting of G, E, and Q;
c-3) the amino acid residue at position 45 is selected from the group consisting of L and R;
c-4) the amino acid residue at position 103 is selected from the group consisting of R and S; and
c-5) the amino acid residue at position 108 is Q;
wherein the amino acid position is according to Kabat numbering, and wherein Q at position 108 can be optionally humanized to L.

Embodiment 7

The isolated anti-CTLA-4 construct of embodiment 6, wherein the sdAb moiety comprises a $V_HH$ domain comprising the amino acid sequence of any one of the following:
a-1) the amino acid residue at position 37 is selected from the group consisting of F and Y;
a-2) the amino acid residue at position 44 is selected from the group consisting of G, E and Q;
a-3) the amino acid residue at position 45 is selected from the group consisting of L and R;
a-4) the amino acid residue at position 103 is W; and
a-5) the amino acid residue at position 108 is Q; or
b-1) the amino acid residue at position 37 is F;
b-2) the amino acid residue at position 44 is selected from the group consisting of E and Q;
b-3) the amino acid residue at position 45 is R;
b-4) the amino acid residue at position 103 is W; and
b-5) the amino acid residue at position 108 is Q; or
c-1) the amino acid residue at position 37 is F;
c-2) the amino acid residue at position 44 is selected from the group consisting of G, E, and Q;
c-3) the amino acid residue at position 45 is selected from the group consisting of L and R;
c-4) the amino acid residue at position 103 is selected from the group consisting of R and S; and
c-5) the amino acid residue at position 108 is Q;
wherein the amino acid position is according to Kabat numbering, and wherein Q at position 108 can be optionally humanized to L.

Embodiment 8

The isolated anti-CTLA-4 construct of any one of embodiments 1-7, wherein the sdAb moiety comprises a $V_HH$ domain comprising the amino acid sequence of any one of SEQ ID NOs: 113-129, 200-202, 274-282, 341-344, 352, and 353, or a variant thereof having at least about 80% sequence identify to any one of SEQ ID NOs: 113-129, 200-202, 274-282, 341-344, 352, and 353.

Embodiment 9

The isolated anti-CTLA-4 construct of embodiment 8, wherein the sdAb moiety comprises a $V_HH$ domain comprising the amino acid sequence of any one of SEQ ID NOs: 113-129, 200-202, 274-282, 341-344, 352, and 353, or a variant thereof having at least about 90% sequence identify to any one of SEQ ID NOs: 113-129, 200-202, 274-282, 341-344, 352, and 353.

Embodiment 10

The isolated anti-CTLA-4 construct of embodiment 9, wherein the sdAb moiety comprises a $V_HH$ domain comprising the amino acid sequence of any one of SEQ ID NOs: 113-129, 200-202, 274-282, 341-344, 352, and 353, or a variant thereof having at least about 95% sequence identify to any one of SEQ ID NOs: 113-129, 200-202, 274-282, 341-344, 352, and 353.

Embodiment 11

The isolated anti-CTLA-4 construct of embodiment 10, wherein the sdAb moiety comprises a $V_HH$ domain comprising the amino acid sequence of any one of SEQ ID NOs: 113-129, 200-202, 274-282, 341-344, 352, and 353, or a variant thereof comprising up to about 3 amino acid substitutions in the $V_HH$ domain.

Embodiment 12

The isolated anti-CTLA-4 construct of embodiment 11, wherein the sdAb moiety comprises a $V_HH$ domain comprising the amino acid sequence of any one of SEQ ID NOs: 114, 129, 201, 202, 274-282, 341-344, 352, and 353.

Embodiment 13

The isolated anti-CTLA-4 construct of any one of embodiments 1-12, wherein the $K_d$ of the binding between the sdAb moiety and CTLA-4 is about $10^{-5}$ M to about $10^{-12}$ M.

Embodiment 14

The isolated anti-CTLA-4 construct of embodiment 13, wherein the $K_d$ of the binding between the sdAb moiety and CTLA-4 is about $10^{-7}$ M to about $10^{-12}$ M.

Embodiment 15

The isolated anti-CTLA-4 construct of embodiment 14, wherein the $K_d$ of the binding between the sdAb moiety and CTLA-4 is about $10^{-8}$ M to about $10^{-12}$ M.

Embodiment 16

The isolated anti-CTLA-4 construct of any one of embodiments 1-15, wherein the sdAb moiety specifically recognizing CTLA-4 is camelid, chimeric, human, partially humanized, or fully humanized.

Embodiment 17

The isolated anti-CTLA-4 construct of any one of embodiments 1-16, wherein the isolated anti-CTLA-4 construct is a heavy chain-only antibody (HCAb).

Embodiment 18

The isolated anti-CTLA-4 construct of embodiment 16, wherein the sdAb moiety that specifically recognizes CTLA-4 is fused to a human IgG1 Fc.

Embodiment 19

The isolated anti-CTLA-4 construct of embodiment 17 or 18, wherein the HCAb is monomeric or dimeric.

Embodiment 20

The isolated anti-CTLA-4 construct of any one of embodiments 17-19, wherein the HCAb comprises the amino acid sequence of any one of SEQ ID NOs: 130-133, 283-291, and 366-371.

Embodiment 21

The isolated anti-CTLA-4 construct of any one of embodiments 1-16, wherein the isolated anti-CTLA-4 construct further comprises a second antibody moiety specifically recognizing a second epitope.

Embodiment 22

The isolated anti-CTLA-4 construct of embodiment 21, wherein the second antibody moiety is a full-length antibody, a Fab, a Fab', a (Fab')2, an Fv, a single chain Fv (scFv), an scFv-scFv, a minibody, a diabody, or an sdAb.

Embodiment 23

The isolated anti-CTLA-4 construct of embodiment 21 or 22, wherein the anti-CTLA-4 construct is monospecific.

Embodiment 24

The isolated anti-CTLA-4 construct of embodiment 21 or 22, wherein the anti-CTLA-4 construct is multispecific.

Embodiment 25

The isolated anti-CTLA-4 construct of embodiment 24, wherein the anti-CTLA-4 construct is bispecific.

Embodiment 26

The isolated anti-CTLA-4 construct of any one of embodiments 21-25, wherein the sdAb moiety specifically recognizing CTLA-4 is fused to the N-terminus and/or C-terminus of the second antibody moiety.

Embodiment 27

The isolated anti-CTLA-4 construct of any one of embodiments 21-26, wherein the sdAb moiety specifically recognizing CTLA-4 and the second antibody moiety are optionally connected by a peptide linker.

Embodiment 28

The isolated anti-CTLA-4 construct of embodiment 27, wherein the peptide linker comprises the amino acid sequence of SEQ ID NO: 162, 163, 307, or 365.

Embodiment 29

The isolated anti-CTLA-4 construct of any one of embodiments 21-28, wherein the second antibody moiety is an sdAb.

Embodiment 30

The isolated anti-CTLA-4 construct of embodiment 29, wherein the second epitope is from CTLA-4.

Embodiment 31

The isolated anti-CTLA-4 construct of embodiment 30, wherein the isolated anti-CTLA-4 construct comprises two or more sdAbs that specifically recognize epitope(s) from CTLA-4.

Embodiment 32

The isolated anti-CTLA-4 construct of embodiment 29, wherein the second epitope is from human serum albumin (HSA).

Embodiment 33

The isolated anti-CTLA-4 construct of any one of embodiments 21-28, wherein the second antibody moiety is a full-length antibody consisting of two heavy chains and two light chains.

Embodiment 34

The isolated anti-CTLA-4 construct of embodiment 33, wherein the N-terminus of the sdAb moiety specifically recognizing CTLA-4 is fused to the C-terminus of at least one of the heavy chains of the full-length antibody.

Embodiment 35

The isolated anti-CTLA-4 construct of embodiment 33, wherein the C-terminus of the sdAb moiety specifically recognizing CTLA-4 is fused to the N-terminus of at least one of the heavy chains of the full-length antibody.

Embodiment 36

The isolated anti-CTLA-4 construct of embodiment 33, wherein the N-terminus of the sdAb moiety specifically recognizing CTLA-4 is fused to the C-terminus of at least one of the light chains of the full-length antibody.

Embodiment 37

The isolated anti-CTLA-4 construct of embodiment 33, wherein the N-terminus of the sdAb moiety specifically recognizing CTLA-4 is fused to the C-terminus of at least one of the light chains of the full-length antibody.

Embodiment 38

The isolated anti-CTLA-4 construct of embodiment 33, wherein the C-terminus of the sdAb moiety specifically recognizing CTLA-4 is fused to the N-terminus of both heavy and light chains of the full-length antibody.

Embodiment 39

The isolated anti-CTLA-4 construct of any one of embodiments 33-38, wherein the full-length antibody specifically recognizes PD-1.

Embodiment 40

The isolated anti-CTLA-4 construct of embodiment 39, wherein the full-length antibody comprises a heavy chain comprising the amino acid sequence of SEQ ID NO: 158, and a light chain comprising the amino acid sequence of SEQ ID NO: 159.

Embodiment 41

The isolated anti-CTLA-4 construct of embodiment 39, wherein the full-length antibody comprises a heavy chain comprising the amino acid sequence of SEQ ID NO: 160, and a light chain comprising the amino acid sequence of SEQ ID NO: 161.

Embodiment 42

The isolated anti-CTLA-4 construct of embodiment 39, wherein the full-length antibody comprises a heavy chain comprising the amino acid sequence of SEQ ID NO: 308, and a light chain comprising the amino acid sequence of SEQ ID NO: 309.

Embodiment 43

The isolated anti-CTLA-4 construct of any one of embodiments 33-42, wherein the full-length antibody comprises a heavy chain comprising the amino acid sequence of SEQ ID NO: 158, and a light chain comprising the amino acid sequence of SEQ ID NO: 159, wherein at least one of the heavy chains of the full-length antibody is fused to the anti-CTLA-4 sdAb, and wherein the heavy chain fusion polypeptide comprises the amino acid sequence of any one of SEQ ID NOs: 134-145, 292-296, and 319-323.

Embodiment 44

The isolated anti-CTLA-4 construct of any one of embodiments 33-42, wherein the full-length antibody comprises a heavy chain comprising the amino acid sequence of SEQ ID NO: 160, and a light chain comprising the amino acid sequence of SEQ ID NO: 161, wherein at least one of the heavy chains of the full-length antibody is fused to the anti-CTLA-4 sdAb, and wherein the heavy chain fusion polypeptide comprises the amino acid sequence of any one of SEQ ID NOs: 146-157, 297-301, and 324-328.

Embodiment 45

The isolated anti-CTLA-4 construct of any one of embodiments 33-42, wherein the full-length antibody comprises a heavy chain comprising the amino acid sequence of SEQ ID NO: 308, and a light chain comprising the amino acid sequence of SEQ ID NO: 309, wherein at least one of the heavy chains of the full-length antibody is fused to the anti-CTLA-4 sdAb, and wherein the heavy chain fusion polypeptide comprises the amino acid sequence of any one of SEQ ID NOs: 310-318 and 329-337.

Embodiment 46

The isolated anti-CTLA-4 construct of any one of embodiments 33-42, wherein the full-length antibody comprises a heavy chain comprising the amino acid sequence of SEQ ID NO: 158, and a light chain comprising the amino acid sequence of SEQ ID NO: 159, wherein at least one of the light chains of the full-length antibody is fused to the anti-CTLA-4 sdAb, and wherein the light chain fusion polypeptide comprises the amino acid sequence of any one of SEQ ID NOs: 354 and 355.

Embodiment 47

The isolated anti-CTLA-4 construct of any one of embodiments 33-42, wherein the full-length antibody comprises a heavy chain comprising the amino acid sequence of SEQ ID NO: 158, and a light chain comprising the amino acid sequence of SEQ ID NO: 159, wherein the anti-CTLA-4 sdAb is fused to the N-terminus of both heavy and light chains of the full-length antibody, and wherein the heavy chain fusion polypeptide comprises the amino acid sequence of SEQ ID NO: 356, and the light chain fusion polypeptide comprises the amino acid sequence of SEQ ID NO: 357.

Embodiment 48

The isolated anti-CTLA-4 construct of any one of embodiments 33-42, wherein the anti-CTLA-4 construct comprises four identical sdAbs specifically recognizing CTLA-4, wherein fused to the N-terminus of each heavy chain of the full-length antibody are two identical sdAbs, wherein the two identical sdAbs are fused to each other via an optional peptide linker, and wherein the two identical sdAbs are fused to the N-terminus of each heavy chain of the full-length antibody via an optional peptide linker.

Embodiment 49

The isolated anti-CTLA-4 construct of embodiment 51, wherein the full-length antibody comprises a heavy chain comprising the amino acid sequence of SEQ ID NO: 158, and a light chain comprising the amino acid sequence of SEQ ID NO: 159, and wherein the heavy chain fusion polypeptide comprises the amino acid sequence of SEQ ID NO: 358.

Embodiment 50

The isolated anti-CTLA-4 construct of any one of embodiments 33-38, wherein the full-length antibody specifically recognizes PD-L1.

Embodiment 51

The isolated anti-CTLA-4 construct of embodiment 43, wherein the full-length antibody comprises a heavy chain comprising the amino acid sequence of SEQ ID NO: 195, and a light chain comprising the amino acid sequence of SEQ ID NO: 196.

Embodiment 52

The isolated anti-CTLA-4 construct of embodiment 443, wherein the full-length antibody comprises a heavy chain comprising the amino acid sequence of SEQ ID NO: 197, and a light chain comprising the amino acid sequence of SEQ ID NO: 198.

Embodiment 53

The isolated anti-CTLA-4 construct of any one of embodiments 33-38 and 50-52, wherein the full-length antibody comprises a heavy chain comprising the amino acid sequence of SEQ ID NO: 195, and a light chain comprising the amino acid sequence of SEQ ID NO: 196, wherein at least one of the heavy chains of the full-length antibody is fused to the anti-CTLA-4 sdAb, and wherein the heavy chain fusion polypeptide comprises the amino acid sequence of any one of SEQ ID NOs: 171-182, 302-306, and 345-349.

Embodiment 54

The isolated anti-CTLA-4 construct of any one of embodiments 33-38 and 50-52, wherein the full-length antibody comprises a heavy chain comprising the amino acid sequence of SEQ ID NO: 197, and a light chain comprising the amino acid sequence of SEQ ID NO: 198, wherein at least one of the heavy chains of the full-length antibody is fused to the anti-CTLA-4 sdAb, and wherein the heavy chain fusion polypeptide comprises the amino acid sequence of any one of SEQ ID NOs: 183-194.

Embodiment 55

The isolated anti-CTLA-4 construct of any one of embodiments 33-38 and 50-52, wherein the anti-CTLA-4 construct comprises four identical sdAbs specifically recognizing CTLA-4, wherein fused to the N-terminus of each heavy chain of the full-length antibody are two identical sdAbs, wherein the two identical sdAbs are fused to each other via an optional peptide linker, and wherein the two identical sdAbs are fused to the N-terminus of each heavy chain of the full-length antibody via an optional peptide linker.

Embodiment 56

The isolated anti-CTLA-4 construct of any one of embodiments 1-16, wherein the anti-CTLA-4 construct comprises: (a) a first antigen binding portion comprising the sdAb moiety specifically recognizing CTLA-4, and (b) a second antigen binding portion comprising a heavy chain variable domain ($V_H$) and a light chain variable domain ($V_L$), wherein the $V_H$ and $V_L$ together form an antigen-binding site that specifically binds a second epitope, wherein the first antigen binding portion and the second antigen binding portion are fused to each other.

Embodiment 57

The isolated anti-CTLA-4 construct of embodiment 56, wherein the second epitope is from CTLA-4.

Embodiment 58

The isolated anti-CTLA-4 construct of embodiment 56, wherein the second epitope is not from CTLA-4.

Embodiment 59

The isolated anti-CTLA-4 construct of any one of embodiments 56-58, wherein the anti-CTLA-4 construct is bispecific.

Embodiment 60

The isolated anti-CTLA-4 construct of any one of embodiments 56-59, wherein the second antigen binding portion is a full-length antibody consisting of two heavy chains and two light chains.

Embodiment 61

The isolated anti-CTLA-4 construct of any one of embodiments 56-59, wherein the second antigen binding portion is an antibody fragment comprising a heavy chain comprising the $V_H$ and a light chain comprising the $V_L$.

Embodiment 62

The isolated anti-CTLA-4 construct of embodiment 61, wherein the second antigen binding portion is a Fab.

Embodiment 63

The isolated anti-CTLA-4 construct of any one of embodiments 56-62, wherein the first antigen binding portion comprises a single polypeptide chain comprising the sdAb moiety specifically recognizing CTLA-4.

Embodiment 64

The isolated anti-CTLA-4 construct of embodiment 63, wherein the first antigen binding portion comprises two identical sdAb moieties specifically recognizing CTLA-4 fused together via an optional peptide linker.

Embodiment 65

The isolated anti-CTLA-4 construct of embodiment 63 or 64, wherein the C-terminus of the first antigen binding portion is fused to the N-terminus of at least one heavy chain of the second antigen binding portion.

Embodiment 66

The isolated anti-CTLA-4 construct of embodiment 63 or 64, wherein the C-terminus of the first antigen binding portion is fused to the N-terminus of at least one light chain of the second antigen binding portion.

Embodiment 67

The isolated anti-CTLA-4 construct of embodiment 63 or 64, wherein the N-terminus of the first antigen binding portion is fused to the C-terminus of at least one heavy chain of the second antigen binding portion.

Embodiment 68

The isolated anti-CTLA-4 construct of embodiment 63 or 64, wherein the N-terminus of the first antigen binding portion is fused to the C-terminus of at least one light chain of the second antigen binding portion.

Embodiment 69

The isolated anti-CTLA-4 construct of embodiment 63 or 64, wherein the C-terminus of the first antigen binding portion is fused to the N-terminus of both heavy and light chains of the second antigen binding portion.

Embodiment 70

The isolated anti-CTLA-4 construct of any one of embodiments 56-59 and 63, wherein the second antigen binding portion is an scFv.

Embodiment 71

The isolated anti-CTLA-4 construct of embodiment 70, wherein the C-terminus of the first antigen binding portion is fused to the N-terminus of the second antigen binding portion.

Embodiment 72

The isolated anti-CTLA-4 construct of embodiment 70, wherein the N-terminus of the first antigen binding portion is fused to the C-terminus of the second antigen binding portion.

Embodiment 73

The isolated anti-CTLA-4 construct of any one of embodiments 56-62, wherein the first antigen binding portion is a Fab-like domain comprising a first polypeptide chain comprising a first sdAb moiety specifically recognizing CTLA-4 fused to a $C_H1$ domain, and a second polypeptide chain comprising a second sdAb moiety specifically recognizing CTLA-4 fused to a $C_L$ domain.

Embodiment 74

The isolated anti-CTLA-4 construct of embodiment 73, wherein the first antigen binding portion is fused to the N-terminus of the second antigen binding portion.

Embodiment 75

The isolated anti-CTLA-4 construct of embodiment 73, wherein the first antigen binding portion is fused to the C-terminus of the second antigen binding portion.

Embodiment 76

The isolated anti-CTLA-4 construct of any one of embodiments 56-75, wherein the first and/or second antigen binding portion comprises a human, humanized, human, or chimeric antibody or antigen binding fragment thereof.

Embodiment 77

The isolated anti-CTLA-4 construct of any one of embodiments 56-76, wherein the second antigen binding portion comprises an Fc region.

Embodiment 78

The isolated anti-CTLA-4 construct of embodiment 77, wherein the first antigen binding portion is fused to the N-terminus of the Fc region.

Embodiment 79

The isolated anti-CTLA-4 construct of embodiment 77 or 78, wherein the Fc region is an IgG1 Fc.

Embodiment 80

The isolated anti-CTLA-4 construct of embodiment 79, wherein the Fc region is an IgG4 Fc having an S228P mutation.

Embodiment 81

The isolated anti-CTLA-4 construct of any one of embodiments 56-80, wherein the first antigen binding portion and the second antigen binding portion are fused to each other via an optional peptide linker.

Embodiment 82

The isolated anti-CTLA-4 construct of embodiment 64 or 81, wherein the peptide linker comprises the amino acid sequence of SEQ ID NO: 162, 163, 307, or 365.

Embodiment 83

The isolated anti-CTLA-4 construct of any one of embodiments 56-82, wherein the second epitope is from an immune checkpoint molecule.

Embodiment 84

The isolated anti-CTLA-4 construct of embodiment 83, wherein the immune checkpoint molecule is PD-1 or PD-L1.

Embodiment 85

The isolated anti-CTLA-4 construct of embodiment 84, wherein the second antigen binding portion is an anti-PD-1 antibody or antigen binding fragment thereof.

Embodiment 86

The isolated anti-CTLA-4 construct of embodiment 85, wherein the anti-PD-1 antibody comprises a heavy chain comprising the amino acid sequence of SEQ ID NO: 158, and a light chain comprising the amino acid sequence of SEQ ID NO: 159.

Embodiment 87

The isolated anti-CTLA-4 construct of embodiment 85, wherein the anti-PD-1 antibody comprises a heavy chain comprising the amino acid sequence of SEQ ID NO: 160, and a light chain comprising the amino acid sequence of SEQ ID NO: 161.

Embodiment 88

The isolated anti-CTLA-4 construct of embodiment 85, wherein the full-length antibody comprises a heavy chain comprising the amino acid sequence of SEQ ID NO: 308, and a light chain comprising the amino acid sequence of SEQ ID NO: 309.

Embodiment 89

The isolated anti-CTLA-4 construct of embodiment 85 or 86, comprising two copies of heavy chain fusion polypeptide comprising the amino acid sequence of any one of SEQ ID NOs: 134-145, 292-296, 319-323, 358, and 359, and two copies of light chains comprising the amino acid sequence of SEQ ID NO: 159.

Embodiment 90

The isolated anti-CTLA-4 construct of embodiment 85 or 86, comprising two copies of heavy chains comprising the amino acid sequence of SEQ ID NO: 158, and two copies of light chain fusion polypeptide comprising the amino acid sequence of SEQ ID NO: 354 or 355.

Embodiment 91

The isolated anti-CTLA-4 construct of embodiment 85 or 86, comprising two copies of heavy chain fusion polypeptide comprising the amino acid sequence of SEQ ID NO: 356, and two copies of light chain fusion polypeptide comprising the amino acid sequence of SEQ ID NO: 357.

Embodiment 92

The isolated anti-CTLA-4 construct of embodiment 85 or 86, comprising two copies of heavy chain fusion polypeptide comprising the amino acid sequence of SEQ ID NO: 361, and two copies of light chain fusion polypeptide comprising the amino acid sequence of SEQ ID NO: 362.

Embodiment 93

The isolated anti-CTLA-4 construct of embodiment 85 or 86, comprising two copies of heavy chain fusion polypeptide comprising the amino acid sequence of SEQ ID NO: 363, and two copies of light chain fusion polypeptide comprising the amino acid sequence of SEQ ID NO: 364.

Embodiment 94

The isolated anti-CTLA-4 construct of embodiment 85 or 86, comprising two copies of polypeptide comprising the amino acid sequence of SEQ ID NO: 360.

Embodiment 95

The isolated anti-CTLA-4 construct of embodiment 84, wherein the second antigen binding portion is an anti-PD-L1 antibody or antigen binding fragment thereof.

Embodiment 96

The isolated anti-CTLA-4 construct of embodiment 95, wherein the anti-PD-L1 antibody comprises a heavy chain comprising the amino acid sequence of SEQ ID NO: 195, and a light chain comprising the amino acid sequence of SEQ ID NO: 196.

Embodiment 97

The isolated anti-CTLA-4 construct of embodiment 95, wherein the anti-PD-L1 antibody comprises a heavy chain comprising the amino acid sequence of SEQ ID NO: 197, and a light chain comprising the amino acid sequence of SEQ ID NO: 198.

Embodiment 98

The isolated anti-CTLA-4 construct of any one of embodiments 1-97, wherein the isolated anti-CTLA-4 construct further comprises a biologically active protein or fragments thereof.

Embodiment 99

An isolated anti-CTLA-4 construct comprising an sdAb moiety specifically recognizing CTLA-4, wherein the sdAb moiety comprises CDR1, CDR2, and CDR3 of any one of SEQ ID NOs: 113-129, 200-202, 274-282, 341-344, 352, and 353.

Embodiment 100

An isolated anti-CTLA-4 construct that specifically binds to CTLA-4 competitively with the isolated anti-CTLA-4 construct of any one of embodiments 1-99.

Embodiment 101

A pharmaceutical composition comprising the isolated anti-CTLA-4 construct of any one of embodiments 1-100, and a pharmaceutical acceptable carrier.

Embodiment 102

A method of treating an individual having a CTLA-4-related disease, comprising administering to the individual an effective amount of the pharmaceutical composition of embodiment 101.

Embodiment 103

The method of embodiment 102, wherein the CTLA-4 related disease is cancer.

Embodiment 104

The method of embodiment 103, wherein the cancer is a solid tumor.

Embodiment 105

The method of embodiment 103, wherein the cancer is a colon cancer.

Embodiment 106

The method of any one of embodiments 102-105, further comprising administering to the individual an additional cancer therapy.

Embodiment 107

The method of embodiment 106, wherein the additional cancer therapy is surgery, radiation, chemotherapy, immunotherapy, hormone therapy, or a combination thereof.

Embodiment 108

The method of embodiment 102, wherein the CTLA-4 related disease is a pathogenic infection.

Embodiment 109

The method of any one of embodiments 102-108, wherein the pharmaceutical composition is administered systemically.

Embodiment 110

The method of embodiment 109, wherein the pharmaceutical composition is administered intravenously (i.v.).

Embodiment 111

The method of embodiment 109, wherein the pharmaceutical composition is administered intraperitoneally (i.p.).

Embodiment 112

The method of any one of embodiments 102-108, wherein the pharmaceutical composition is administered locally.

Embodiment 113

The method of embodiment 112, wherein the pharmaceutical composition is administered intratumorally.

Embodiment 114

The method of any one of embodiments 102-113, wherein the individual is a human.

Embodiment 115

An isolated nucleic acid encoding the isolated anti-CTLA-4 construct of any one of embodiments 1-100.

Embodiment 116

The isolated nucleic acid of embodiment 115, wherein the isolated nucleic acid comprises the nucleic acid sequence of any one of SEQ ID NOs: 97-112 and 264-273.

Embodiment 117

A vector comprising the isolated nucleic acid of embodiment 115 or 116.

Embodiment 118

An isolated host cell comprising the isolated nucleic acid of embodiment 115 or 116, or the vector of embodiment 117.

Embodiment 119

A kit comprising the isolated anti-CTLA-4 construct of any one of embodiments 1-100, the isolated nucleic acid of embodiment 115 or 116, the vector of embodiment 117, or the isolated host cell of embodiment 118.

Embodiment 120

A method of producing an anti-CTLA-4 construct, comprising: (a) culturing a host cell comprising the isolated nucleic acid of embodiment 115 or 116, or the vector of embodiment 117, or the isolated host cell of embodiment 118 under conditions effective to express the encoded anti-CTLA-4 construct; and (b) obtaining the expressed anti-CTLA-4 construct from said host cell.

Embodiment 121

The method of embodiment 120, wherein step (a) further comprises producing a host cell comprising the isolated nucleic acid of embodiment 115 or 116, or the vector of embodiment 117.

EXAMPLES

The examples below are intended to be purely exemplary of the invention and should therefore not be considered to limit the invention in any way. The following examples and detailed description are offered by way of illustration and not by way of limitation.

Example 1: Generation of Anti-CTLA-4 sdAbs

Immunization

Figure 1:
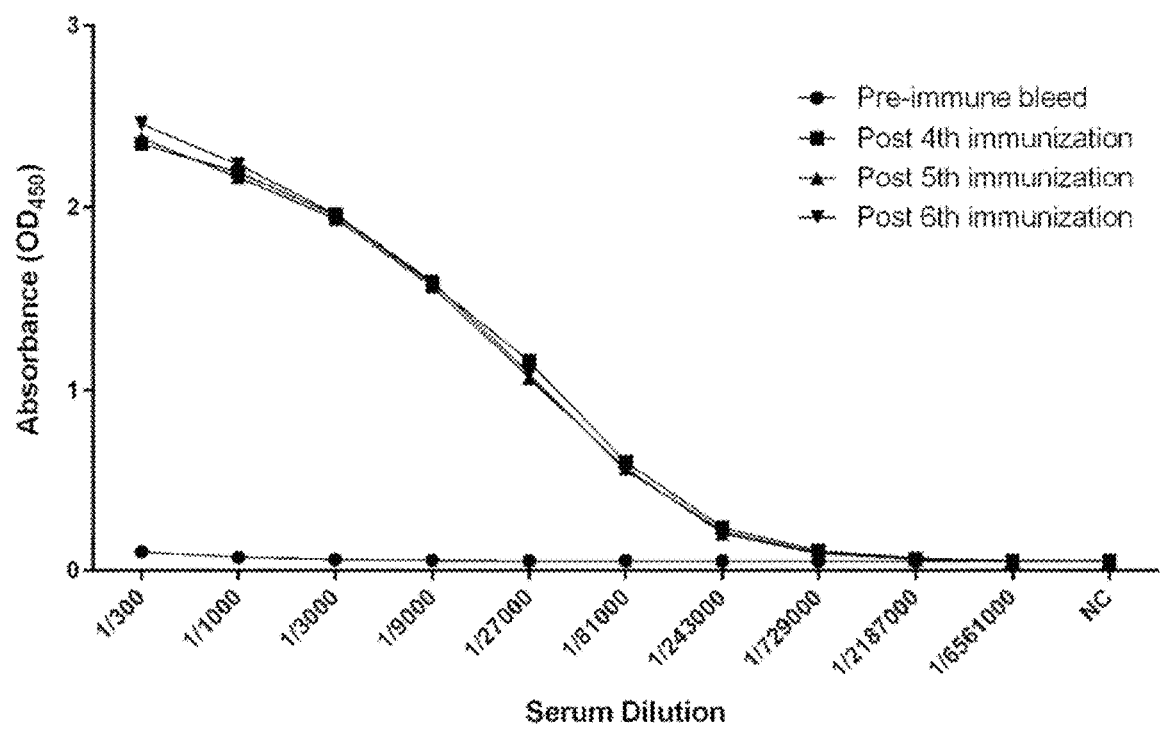
FIG. 1 depicts immune response evaluation of pre-immune serum and immune serum after the 4$^{th}$, 5$^{th}$, and 6$^{th}$ immunization.
Figure 2:
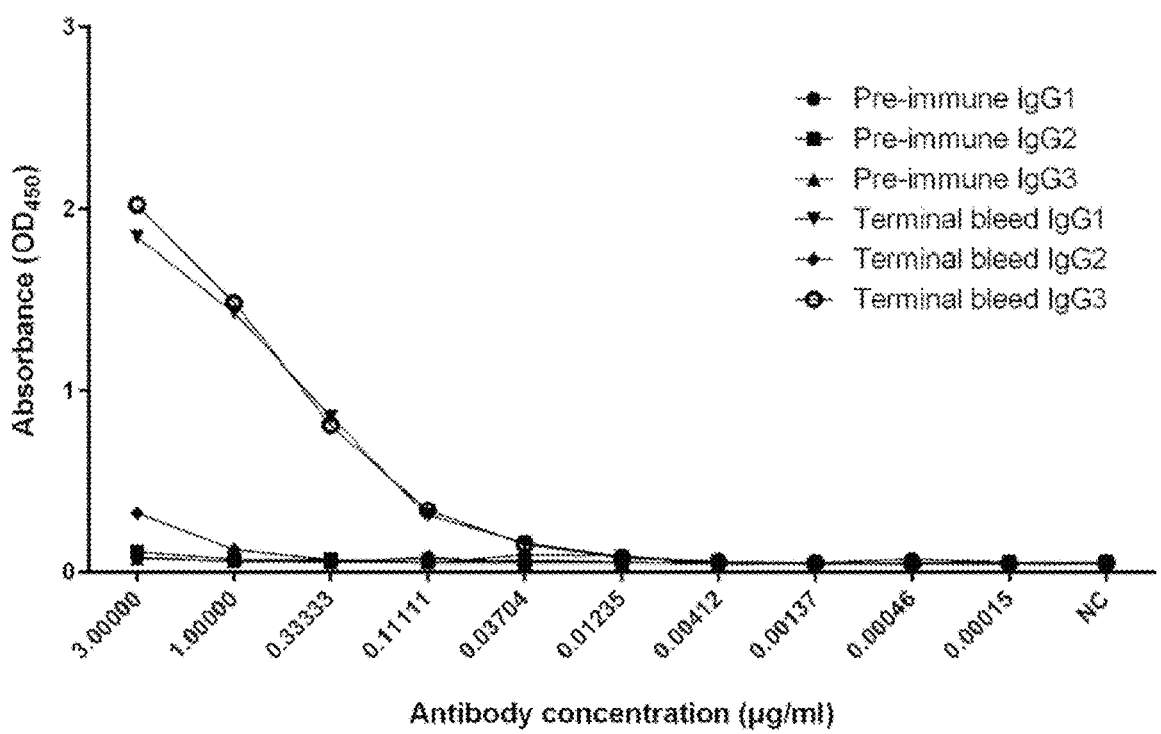
FIG. 2 depicts the immune response evaluation of heavy chain antibodies (IgG2 and IgG3) after the 6$^{th}$ immunization (terminal bleed). Heavy chain antibodies fractionated from pre-immune serum were used as negative controls.

Two llamas were immunized with recombinant CTLA-4 ECD protein under all current animal welfare regulations. For immunization, the antigen was formulated as an emulsion with CFA (primary immunization) or IFA (boost immunization). The antigen was administered by double-spot injections intramuscularly at the neck. Each animal received two injections of the emulsion, containing 100 µg of CTLA-4 ECD and 4 subsequent injections containing 50 µg of antigen at weekly intervals. At different time points during immunization, 10 ml blood samples were collected from the animal and sera were prepared. The induction of an antigen specific humoral immune response was verified using the serum samples in an ELISA-based experiment with immobilized CTLA-4 ECD protein (FIG. 1 and FIG. 2). Five days after the last immunization, a blood sample of 300 ml was collected. Peripheral blood lymphocytes (PBLs), as the genetic source of the llama heavy chain immunoglobulins (HCAbs), were isolated from the 300 ml blood sample using a Ficoll-Paque gradient (Amersham Biosciences), yielding $1 \times 10^9$ PBLs. The maximal diversity of antibodies is expected to be equal to the number of sampled B-lymphocytes, which is about 10% of the number of PBLs ($1 \times 10^8$). The fraction of heavy-chain antibodies in llama is up to 20% of the number of B-lymphocytes. Therefore, the maximal diversity of HCAbs in the 300 ml blood sample is calculated as $2 \times 10^7$ different molecules.

Library Construction

RNA extracted from PBLs and lymph node was used as starting material for RT-PCR to amplify sdAb encoding gene fragments. These fragments were cloned into an in-house phagemid vector. In frame with the sdAb coding sequence, the vector coded for a C-terminal (His)6 tag. The library size is more than $1 \times 10^9$. The library phage was prepared according to a standard protocol and stored after filter sterilization at 4° C. for further use.

Selections and High-Throughput Screening

Selections were carried out with the above libraries using solid panning as well as cell-based panning. Only a single round of selection was performed for both conditions. Each selection output was analyzed for enrichment factor (#phage present in eluate relative to control), diversity and percentage of CTLA-4 positive clones (ELISA). Based on these parameters the best selections were chosen for further analysis. To this end, the output from each selection was recloned as a pool into a soluble expression vector for high-throughput screening. In frame with the sdAb coding sequence, the vector coded for a C-terminal (His)6 tag. Colonies were picked and grown in 96 deep well plates (1 ml volume) and induced by adding IPTG and 0.1% Triton for sdAb expression in the supernatant.

The supernatant was analyzed for their ability to bind to CTLA-4 ECD protein (by ELISA) and CTLA-4 stable cell line (by FACS). The positive binders were sequenced and the unique clones were selected for further characterization (Table 2 and Table 6).

The unique clones were grown in 2XYT medium and induced by IPTG for sdAb expression in the supernatant. The supernatant of unique binders were analyzed for their ability to inhibit CTLA-4-B7-1 interaction. To this end, the supernatant was incubated with CTLA-4 ECD protein, then the complex was added to B7-1 stable cell line for binding evaluation. sdAbs with negative signal on B7-1 cell line are considered as CTLA-4 inhibitors.

All potential inhibitors were selected for off-rate analysis by surface plasmon resonance (SPR) on a BIAcore T200 instrument. The dissociation phase was used to calculate the $k_{off}$ values for each individual sdAb.

sdAb Production

The His6-tagged sdAbs were purified from periplasmic extracts by ÄKTA. The NTA resin was processed according to the manufacturer's instructions. Periplasmic extracts prepared were incubated with the resin for 30 min at RT on a rotator. The resin was washed with PBS and transferred to a column. The packed resin was washed with 15 mM Imidazole. sdAbs were eluted from the column using 150 mM Imidazole. The eluted fractions were analyzed by spotting on Hybond Membrane and visualized with Ponceau. Fractions containing protein were pooled and dialyzed against PBS. Dialyzed protein was collected, filter sterilized, concentration determined and stored at −20° C.

To determine the purity, protein samples were analyzed on a 12% SDS-PAGE gel. 10 µl Laemmli sample buffer was added to 10 µl (2 µg) purified protein, then the sample was heated for 10 minutes at 95° C., cooled and loaded onto a 12% SDS-PAGE gel. The gel was processed according to general procedures and stained with Coomassie Brilliant Blue (CBB).

Inhibition of Ligand Binding by FACS Analysis

Figure 3A:
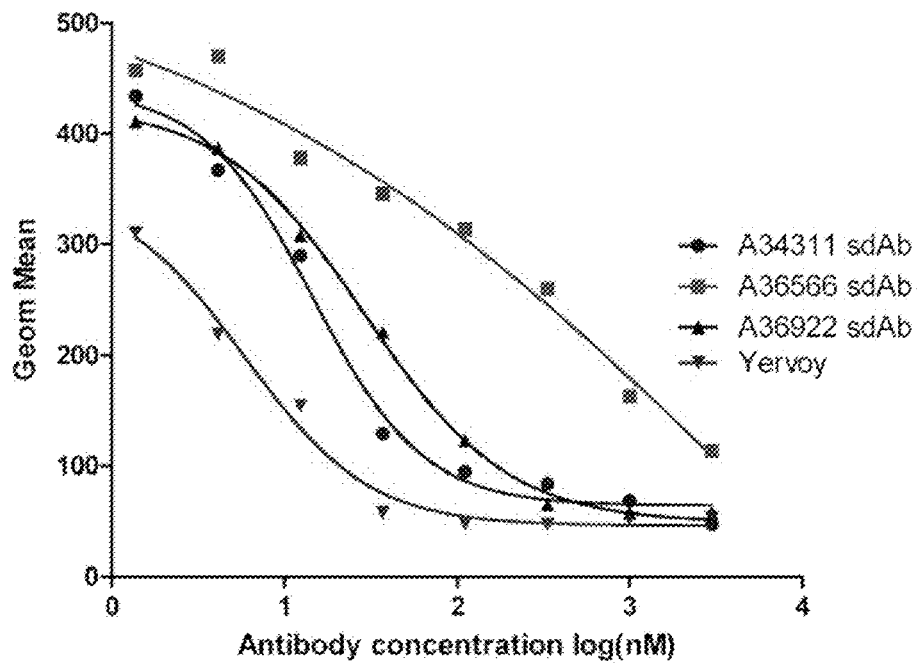
FIGS. 3A-3B depict functional activity evaluation of sdAbs (FIG. 3A) and their heavy chain antibodies (FIG. 3B) by FACS-based ligand competition assay using B7-1 expressing stable cell lines and biotin-labeled hCTLA-4/Fc protein. Yervoy® was used as a positive anti-CTLA-4 antibody control.

Blockade of ligand binding was studied using flow cytometry. For anti-CTLA-4 sdAbs evaluation, CHO cells expressing human B7-1 were dissociated from adherent culture flasks and mixed with varying concentrations of antibodies and a constant concentration of biotin-labeled hCTLA-4/Fc protein (both in a 96-well plate). Yervoy® was used as an anti-CTLA-4 antibody positive control. The mixture was equilibrated for 30 minutes at room temperature, washed three times with FACS buffer (PBS containing 1% BSA). PE/Cy5 Streptavidin secondary antibody was then added and incubated for 15 minutes at room temperature. Cells were washed again with FACS buffer and analyzed by flow cytometry. Data were analyzed with Prism (GraphPad Software, San Diego, Calif.) using non-linear regression, and $IC_{50}$ values were calculated. As can be seen from FIG. 3A, the competition assays demonstrated the ability of anti-CTLA-4 sdAbs (A34311, A36566 and A36922) in efficiently inhibiting CTLA4-B7-1 interactions at low concentrations (1-10 µg/ml), with A34311 as the most potent one with $EC_{50}$ of about 14.52 nM.

sdAb Affinity Determination

Affinity constant ($K_d$) of each sdAbs was determined by surface plasmon resonance (SPR) on a BIAcore T200 instrument.

For determining the affinities of some of the anti-CTLA-4 sdAbs, CTLA-4 ECD (CTLA-4-Fc) was amine-coupled to a CM5 sensor chip at a density of about 50 RU. Anti-CTLA-4 sdAbs were injected at 4 different concentrations between 1 and 81 nM. Flow rate was 30 µl/min in all experiments. Association and dissociation phases were 3 and 10 min, respectively. The chip was regenerated using Glycine/HCl pH 1.5. Binding curves at different sdAb concentrations were used to calculate the kinetic parameters $k_{on}$, $k_{off}$ and $K_d$ (see FIG. 9 for A34311 sdAb affinity data).

The affinities of the rest anti-CTLA-4 sdAbs were determined by amine-coupling CTLA-4-His protein to a CM5 sensor chip at a density of about 50 RU. Anti-CTLA-4 sdAbs were injected at 6 different concentrations between 5 and 160 nM. Flow rate was 30 µl/min in all experiments. Association and dissociation phases were 3 and 10 min, respectively. The chip was regenerated using Glycine/HCl pH 1.5. Binding curves at different sdAb concentrations were used to calculate the kinetic parameters $k_{on}$, $k_{off}$ and $K_d$ (see FIGS. 22A-22B for AS07014 sdAb and AS07189 sdAb affinity data).

CTLA-4-Based Blockade Assay

Human CD4+ T cells were purified from PBMC by the isolation kits (Miltenyl Biotec). Each well contained $10^5$ CD4+ T cells and $10^4$ CHO-K1/human CD80 (CHO-K1 stably expressing human CD80) with a final working volume of 200 µl. Eight test purified sdAbs were added into each well at different concentrations. No antibody was used as a background control. Human IgG4 was used as a negative control, and Yervoy® was used as a positive anti-CTLA4 antibody control. CTLA-4-Fc (GenScript, Z03373-50) was added into the system to initiate the reaction. After 24-hour incubation in 37° C./5% $CO_2$ incubator, 100 µl medium was taken from each testing well for IL-2 measurement (Cisbio). Antibody concentration-dependent secretion of IL-2 by T cells in the CTLA-4 blockade bioassays was used to extract an $EC_{50}$ value for each test antibody, as well as for the positive control full-length anti-CTLA-4 antibody Yervoy®. As can be seen from FIG. 4 and FIGS. 27A-27C, nine sdAbs (A37067, A34625, A34311, A34313, A36566, A36922, AS07014, AS07189, and AS07745) inhibited the binding between CTLA-4 and B7-1, among which A34311, A36566, A36922, AS07014, AS07189, and AS07745 sdAbs exhibited stronger functional activities.

Example 2: Anti-CTLA-4 sdAb Humanization

Protein sequence of sdAb A34311 was aligned with the 5 closest human germline sequences sharing the highest degree of homology. The best human germline sequence was selected as human acceptor. Amino acid differences in the framework regions relative to the human acceptor were shaded in dark grey (FIG. 6 and FIG. 31A). Homology model was made. According to the model analysis data, residues potentially critical for antigen binding or antibody scaffold formation were left untouched while the rest were selected for conversion into the human counterpart. Initially a panel of 4-6 sequence optimized variants was generated (stage 1). These variants were analyzed for a number of parameters and the results obtained were used to design a second set of sdAbs (stage 2). Top four humanized sdAbs (AS02636, AS02626, AS02640, and A34311VH11) were selected based on binding, stability and functional activity data, and their sequence alignments are shown in FIG. 6 and FIG. 31A (other humanized sdAbs are also shown).

Top humanized sdAbs for AS07014 (AS07014VH11, AS07014VH11G54, AS07014VH11SGA, AS07014VH11SGQ and AS07014VH11SGS) and top humanized sdAbs for AS07189 (AS07189TKDVH11, AS07189TKDVH11F27 and AS07189TKDVH11FY) were similarly generated, screened, and selected. Their sequence alignments are shown in FIG. 31B and FIG. 31C (other humanized sdAbs are also shown).

Humanized sdAb Production

Humanized His6-tagged sdAbs were purified from periplasmic extracts by ÄKTA. The sdAb production and purity determination protocol was according to that in Example 1.

Inhibition of Ligand Binding by FACS Analysis

Figure 7:
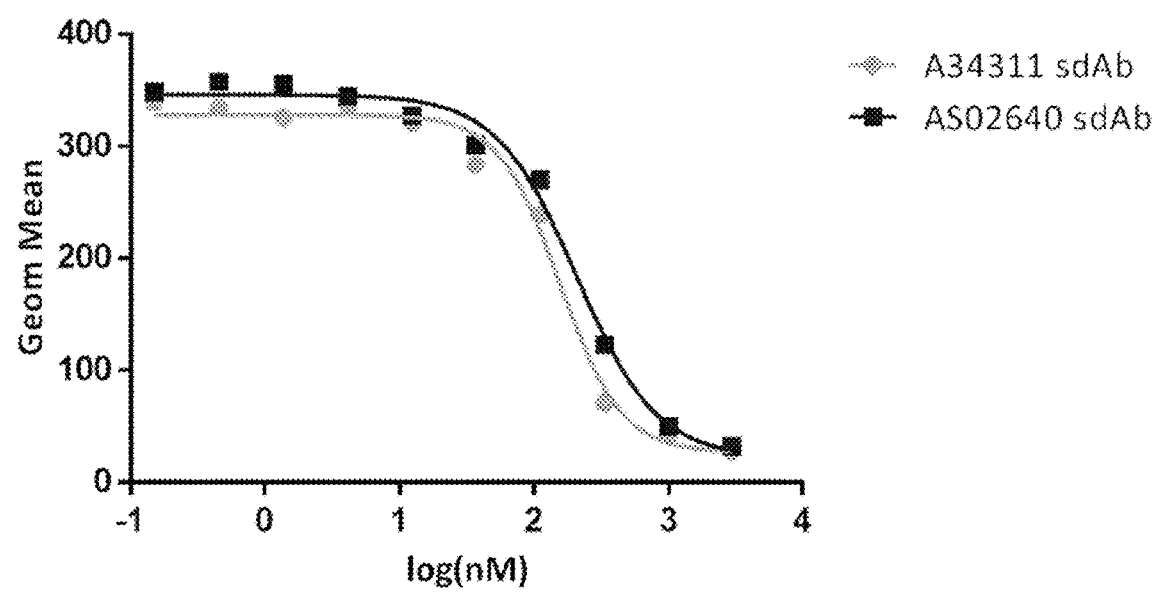
FIG. 7 depicts functional activity evaluation of A34311 sdAb and humanized sdAb AS02640 by FACS-based ligand competition assay, using B7-1 expressing stable cell lines and biotin-labeled hCTLA-4 Fc protein.

The purified humanized sdAbs were tested for their abilities to inhibit CTLA-4-B7-1 binding by FACS analysis, as described in Example 1. The competition assay results indicated that the humanized sdAbs could efficiently inhibit CTLA-4-B7-1 interactions at low concentrations (1-10 µg/ml; see FIG. 7 AS02640 sdAb for example).

Affinity Determination of Humanized sdAbs

Figure 9:
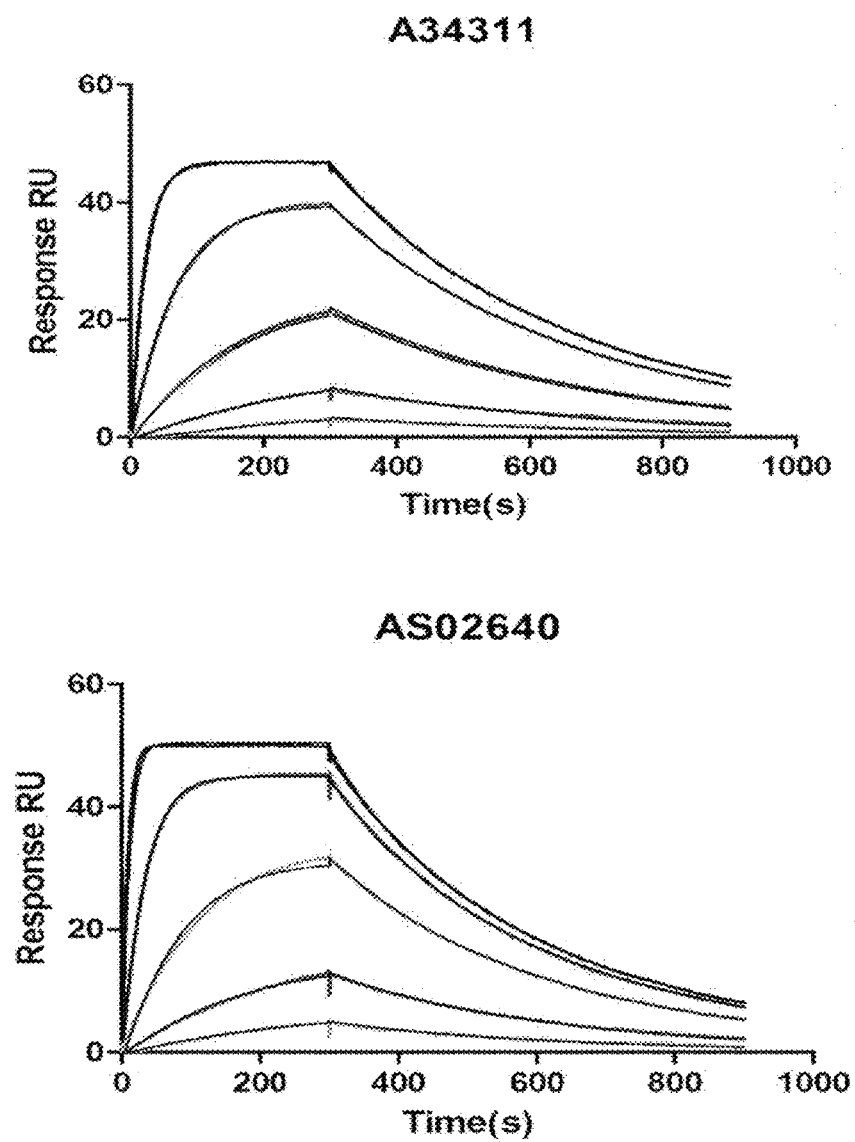
FIG. 9 depicts the affinity determination of exemplary sdAb A34311 and its humanized version (AS02640). CTLA-4 Fc protein was immobilized onto the chip and the two sdAbs were flowed as analyte at concentrations of 1, 3, 9, 27, and 81 nM.

Affinity constant ($K_d$) of each humanized sdAb was determined by surface plasmon resonance (SPR) on a BIAcore T200 instrument, as described in Example 1. Binding curves at different concentrations of sdAbs were used to calculate the kinetic parameters $k_{on}$, $k_{off}$ and $K_d$ (FIG. 9). As can be seen from FIG. 9, the binding affinity of humanized clone AS02640 was comparable to that of the wildtype sdAb A34311.

CTLA-4 Based Blockade Assay

CTLA-4 based blockade assay was performed as described in Example 1. The humanized sdAb AS02640 was found to effectively inhibit the binding between CTLA-4 and B7-1, as reflected by IL-2 production by T cells (FIG. 8, FIGS. 27A-27C).

Example 3: HCAb Construction, Production and Characterization sdAbs with functional activities and slow off-rate from the above studies (A34311, A36566, A34313, and A36922 sdAbs) were selected for HCAb construction and production. DNA sequences of selected sdAbs were fused with DNA sequences of human IgG1 Fc to make HCAb constructs. The HCAb constructs were transfected into mammalian cell lines for HCAb expression. Secreted HCAbs in the condition medium were purified by protein A column.

Inhibition of Ligand Binding by FACS Analysis

Figure 3B:
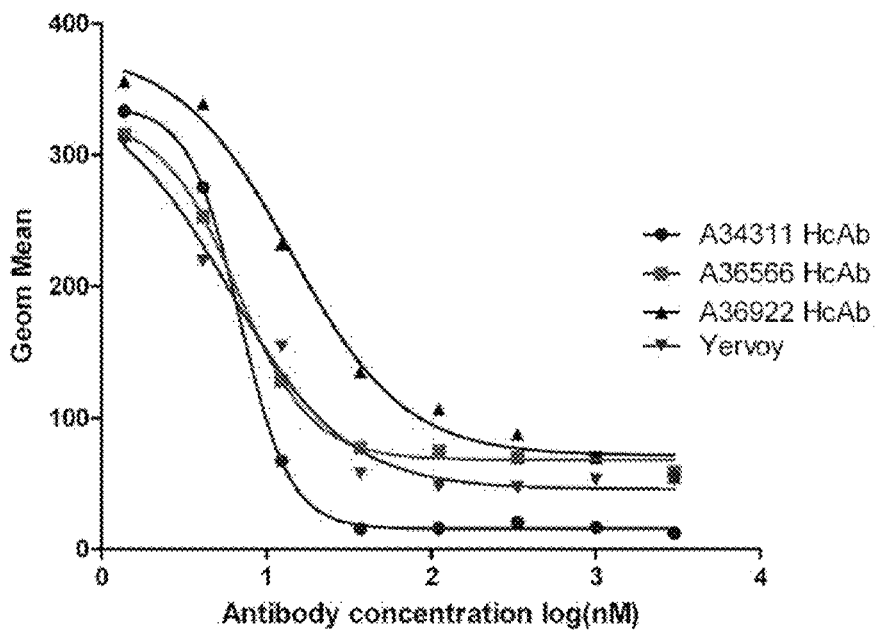
Figure 4:
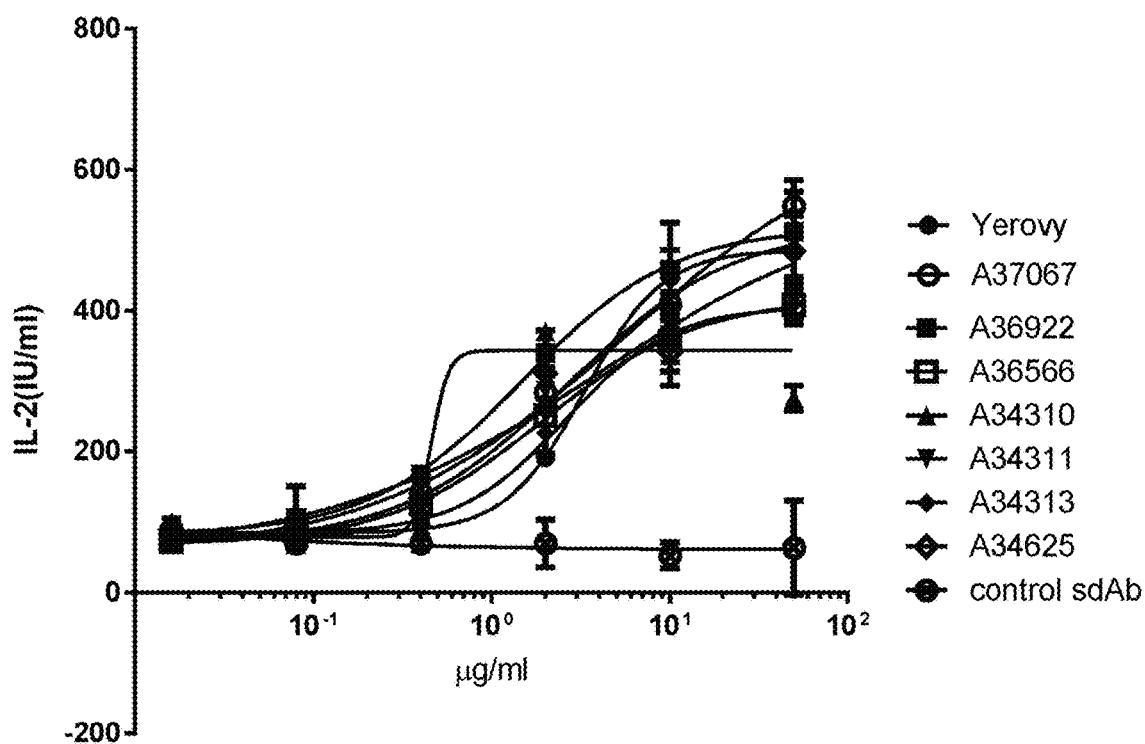
FIG. 4 depicts functional activity evaluation of purified sdAbs by CTLA-4-based blockade assay. Yervoy® was used as a positive anti-CTLA-4 antibody control.
Figure 5A:
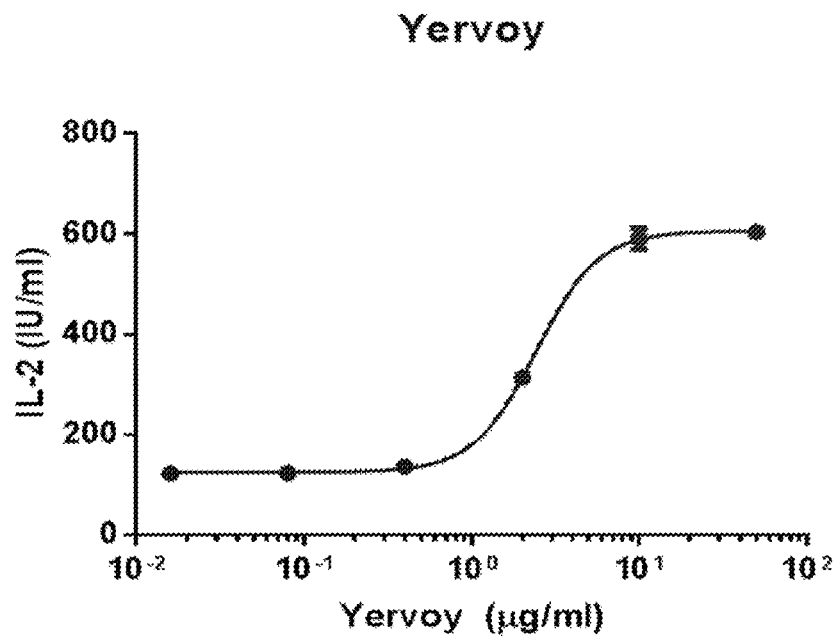
FIGS. 5A-5F depict functional activity evaluation of purified top HCAbs (FIGS. 5B-5E) by CTLA-4-based blockade assay. Yervoy® served as a positive anti-CTLA-4 antibody control (FIG. 5A). $EC_{50}$ from all assays was summarized in FIG. 5F.
Figure 5B:
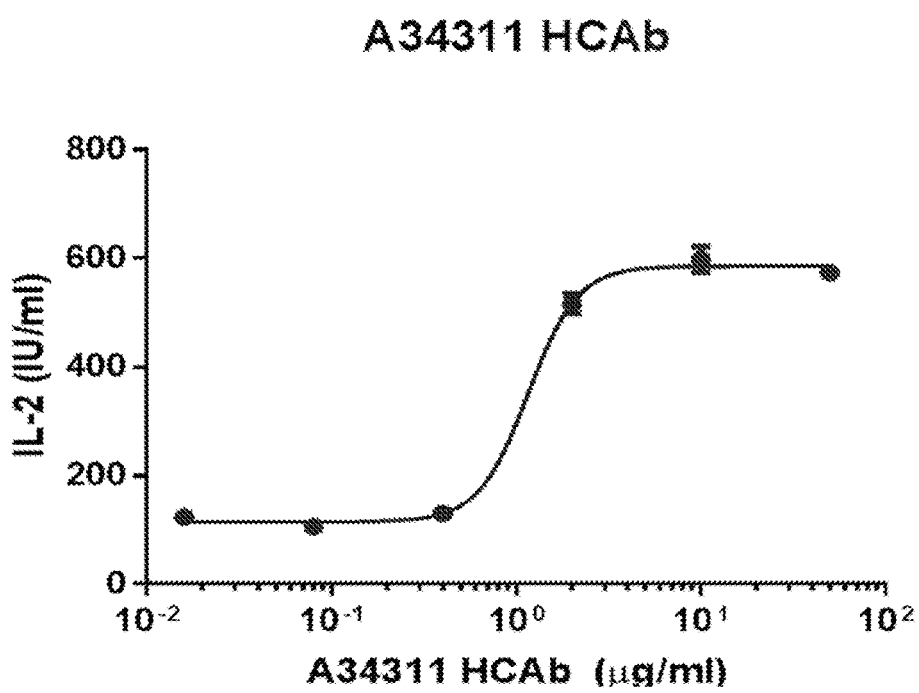
Figure 5C:
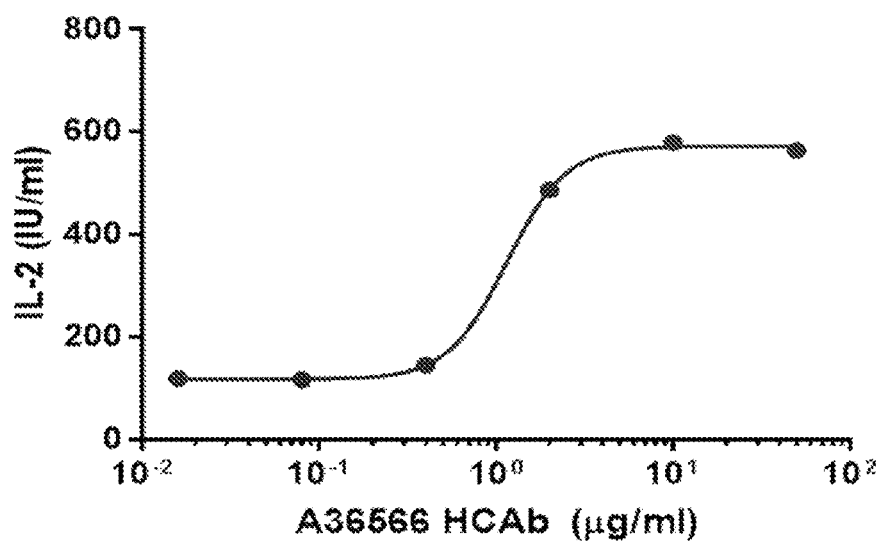
Figure 5D:
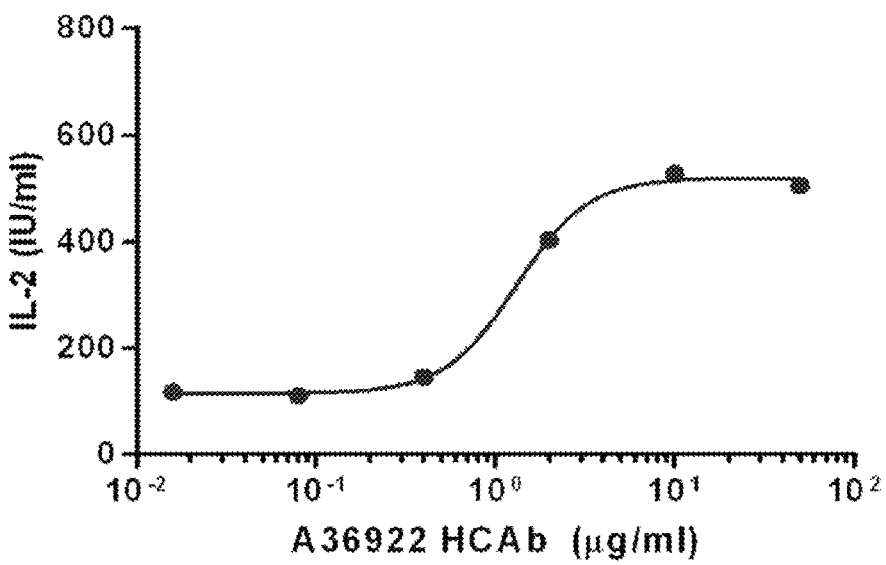
Figures 5E, 5F:
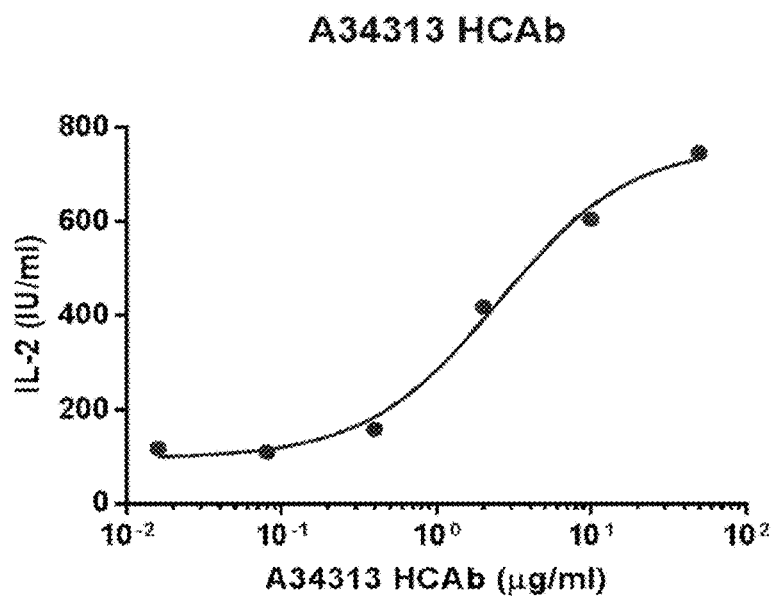

Purified anti-CTLA-4 HCAbs (A34311 HCAb, A36566 HCAb and A36922 HCAb) were tested for their abilities to inhibit CTLA-4/B7-1 binding by FACS analysis, as described in Example 1. As can be seen from FIG. 3B, the competition assays demonstrated the ability of anti-CTLA-4 HCAbs in efficiently inhibiting CTLA-4/B7-1 interactions at low concentrations (1-10 µg/ml). And according to $EC_{50}$ of the FACS data, A34311 HCAb, A36566 HCAb and A36922 HCAb showed comparable functional activity as the market drug Yervoy® (FIG. 3B).

CTLA-4 Based Blockade Assay

Figure 10:
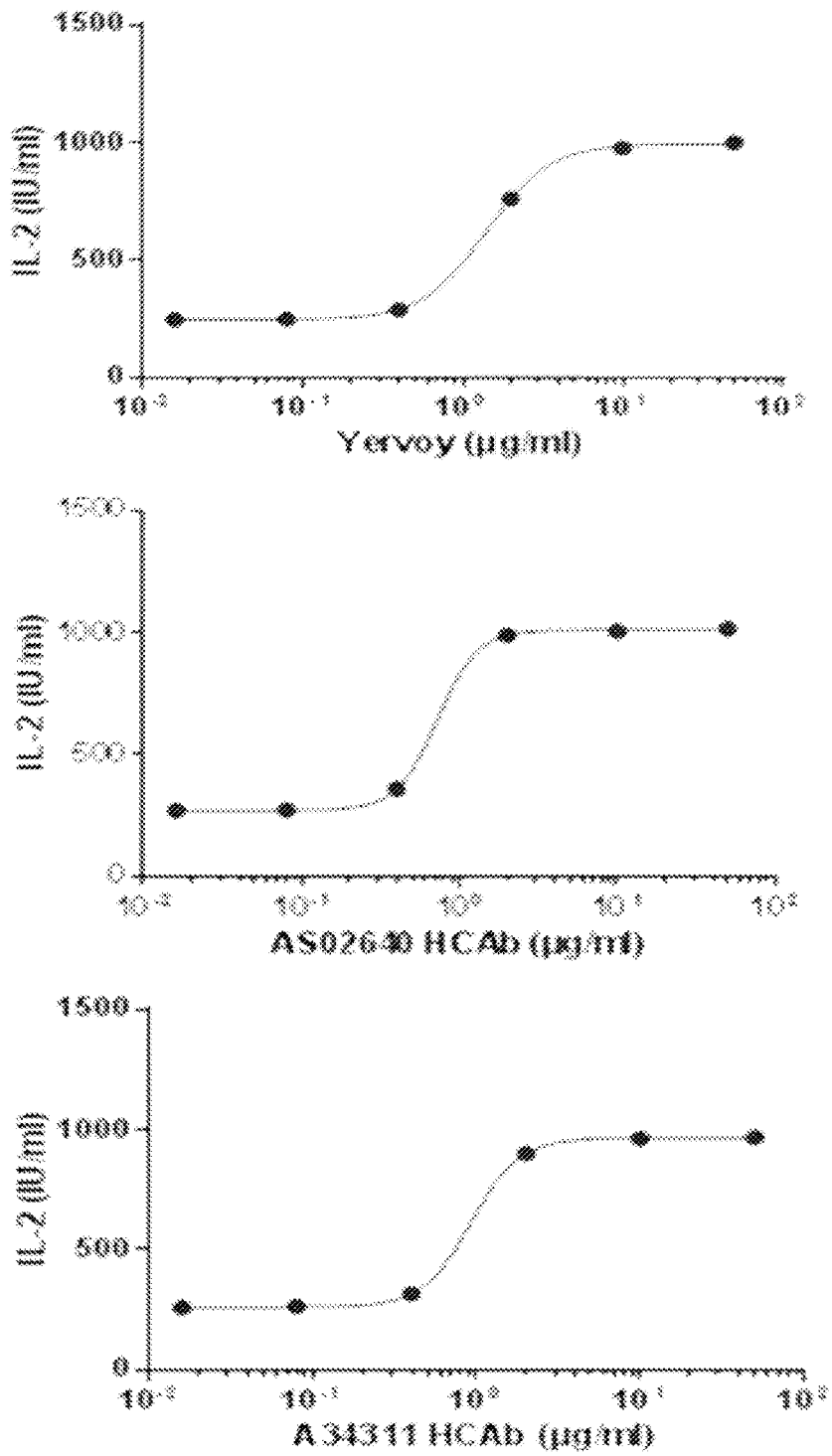
FIG. 10 depicts functional activity evaluation of A34311 HCAb and AS02640 HCAb by CTLA-4-based blockade assay. Yervoy® served as a positive anti-CTLA-4 antibody control.

CTLA-4 based blockade assay was performed as described in Example 1. As can be seen from FIGS. 5A-5F and FIG. 10, A34311 HCAb, A36566 HCAb, A36922 HCAb, and A34313 HCAb showed comparable functional activity as the market drug Yervoy® in inhibiting the binding between CTLA-4 and B7-1, consistent with the FACS-based ligand competition assay results (FIG. 3B). The functional activities of A34311 HCAb and AS02640 HCAb were very close (FIG. 10), suggesting that antibody affinity and activity were not affected after sdAb humanization.

Affinity Determination of Anti-CTLA-4 HCAb

Figure 13A:
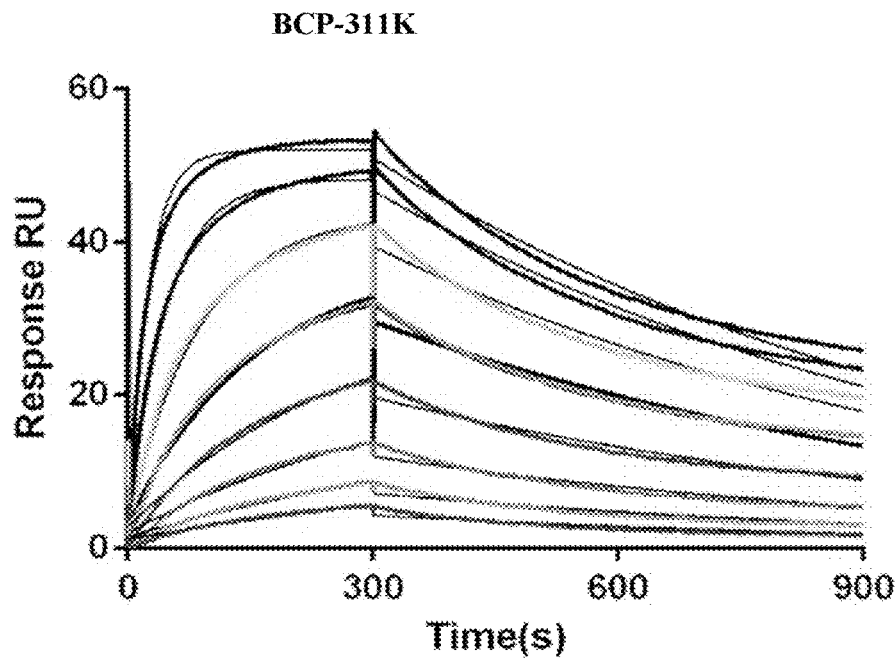
Figure 13B:
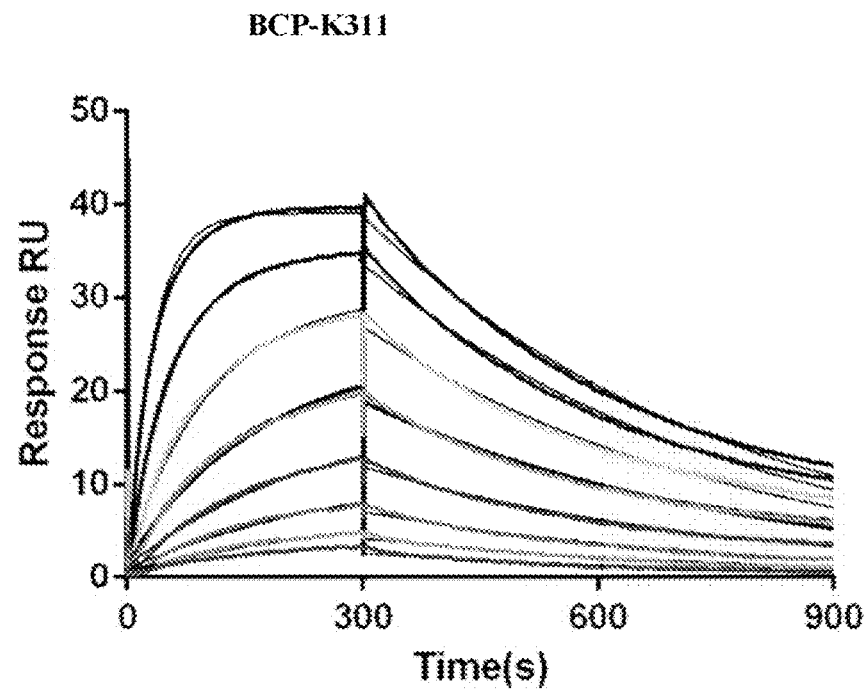
Figure 13C:
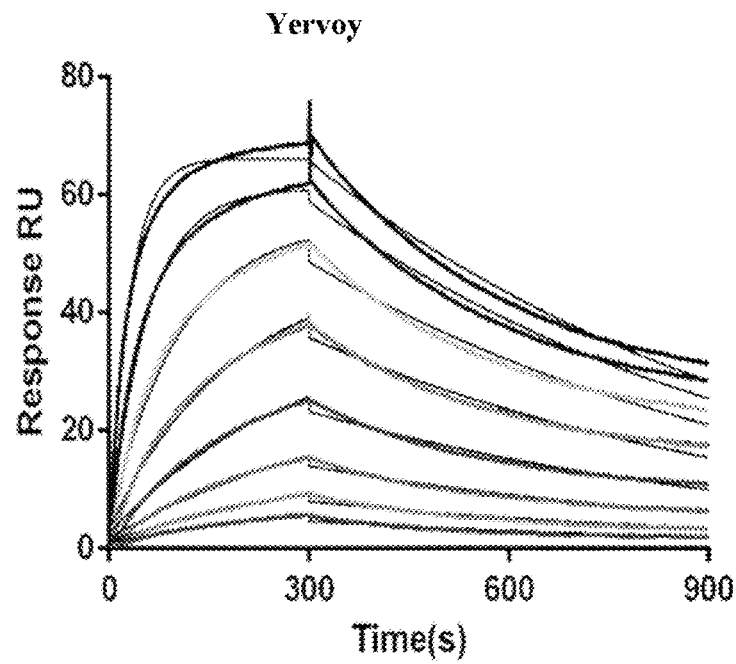
Figure 13D:
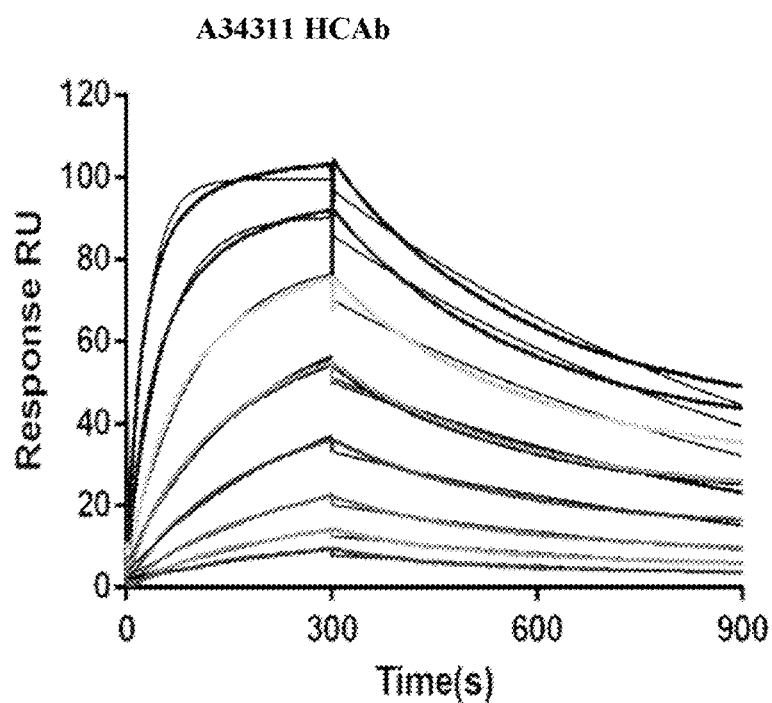

After purification, the binding affinity parameters of A34311 HCAb were measured with a similar method as described in Example 1. Yervoy® was used as a positive control for anti-CTLA-4 antibody. Briefly, antibodies were immobilized onto a CM5 sensor chip, and CTLA-4-His protein was flowed as analyte at concentrations of 0.78, 1.56, 3.15, 6.25, 12.5, 25, 50, and 100 nM. As can be seen from FIGS. 13C-13E, the binding affinity of A34311 HCAb to CTLA-4 was very close to Yervoy®.

Example 4: Generation and Characterization of Multivalent Constructs or Bispecific Antibodies Comprising the Anti-CTLA-4 sdAbs The anti-CTLA-4 sdAbs described herein can also be expressed as bispecific constructs comprising a C-terminal anti-HSA sdAb, a 9-amino acid Gly/Ser (9GS) linker and an N-terminal anti-CTLA-4 sdAb. In addition, trivalent and bispecific antibodies can be constructed comprising C-terminal and N-terminal anti-CTLA-4 sdAbs described herein, and an anti-HSA sdAb in the middle, optionally all connected via 9-amino acid Gly/Ser linkers. The C-terminal or N-terminal anti-CTLA-4 sdAbs can be substituted with anti-PD-1 sdAbs or anti-PD-L1 sdAbs.

Bispecific antibodies can be constructed with an anti-CTLA-4 sdAb fused to a full-length antibody, such as anti-PD-1 antibodies, e.g., Keytruda® (Pembrolizumab), Opdivo® (nivolumab), or anti-PD-L1 antibodies, e.g., Tecentriq® (Atezolizumab), IMFINZI™(Durvalumab). The anti-CTLA-4 sdAb can be connected to the full-length antibody via a linker (such as 9-amino acid Gly/Ser linker (9GS linker), human IgG1 (hIgG1) hinge, or mutated hIgG1 hinge), or without a linker. The anti-CTLA-4 sdAb can be fused to the N-terminus or C-terminus of at least one of the heavy chains.

Bispecific CTLA-4×PD-1 and CTLA-4×PD-L1 Antibody Production

Bispecific antibodies comprising an anti-CTLA-4 sdAb (A34311 or AS02640) fused to N-terminus or C-terminus of the heavy chain of an anti-PD-1 full-length antibody (Keytruda® (Pembrolizumab) or Opdivo® (nivolumab)) with or without a linker (9-amino acid Gly/Ser linker or human IgG1 hinge) were constructed (see Table 4 for all CTLA-4×PD-1 constructs generated). Bispecific antibodies comprising an anti-CTLA-4 sdAb (A34311 or AS02640) fused to N-terminus or C-terminus of the heavy chain of an anti-PD-L1 full-length antibody (Tecentriq® (Atezolizumab) or IMFINZI™ (Durvalumab)) with or without a linker (9-amino acid Gly/Ser linker or human IgG1 hinge) were also constructed (see Table 5 for all CTLA-4×PD-L1 constructs generated). Of the CTLA-4×PD-L1 constructs, A34311-9GS-Tecentriq, A34311-hIgG1 hinge-Tecentriq, A34311-Tecentriq, AS02640-9GS-Tecentriq, AS02640-hIgG1 hinge-Tecentriq, AS02640-Tecentriq, A34311-9GS-Durvalumab, A34311-hIgG1 hinge-Durvalumab, A34311-Durvalumab, AS02640-9GS-Durvalumab, AS02640-hIgG1 hinge-Durvalumab, and AS02640-Durvalumab were constructed, expressed, and subsequently purified; Tecentriq-9GS-A34311, Tecentriq-hIgG1 hinge-A34311, Tecentriq-A34311, Tecentriq-9GS-AS02640, Tecentriq-hIgG1 hinge-AS02640, Tecentriq-AS02640, Durvalumab-9GS-A34311, Durvalumab-hIgG1 hinge-A34311, Durvalumab-A34311, Durvalumab-9GS-AS02640, Durvalumab-hIgG1 hinge-AS02640, and Durvalumab-AS02640 are constructed and expressed, and subsequently purified.

The bispecific constructs were expressed in CHO cells and subsequently purified from the culture medium by affinity chromatography and size exclusion chromatography (SEC).

Affinity Determination of Bispecific CTLA-4×PD-1 Antibodies

After purification, the binding affinity parameters of the bispecific antibodies were measured and compared with their monomer antibodies (anti-CTLA-4 Ab or anti-PD-1 Ab), with a similar method as described in Example 1. Briefly, antibodies were immobilized onto a CM5 sensor chip, and CTLA-4-His or PD-1-His protein was flowed as analyte at concentrations of 0.78, 1.56, 3.15, 6.25, 12.5, 25, 50, and 100 nM.

The binding kinetics data of two exemplary CTLA-4×PD-1 bispecific antibodies, BCP-311K and BCP-K311 are shown in FIGS. 12A-12D and FIGS. 13A-13E. The results indicated that the affinities of the constructed CTLA-4×PD-1 bispecific antibodies to PD-1 and CTLA-4 were very close to their monoclonal antibody anti-PD-1 Keytruda® (FIGS. 12A-12D), and A34311 HCAb and anti-CTLA-4 Ab Yervoy® (FIGS. 13A-13E), respectively.

Inhibition of Ligand Binding by FACS Analysis

Figure 14:
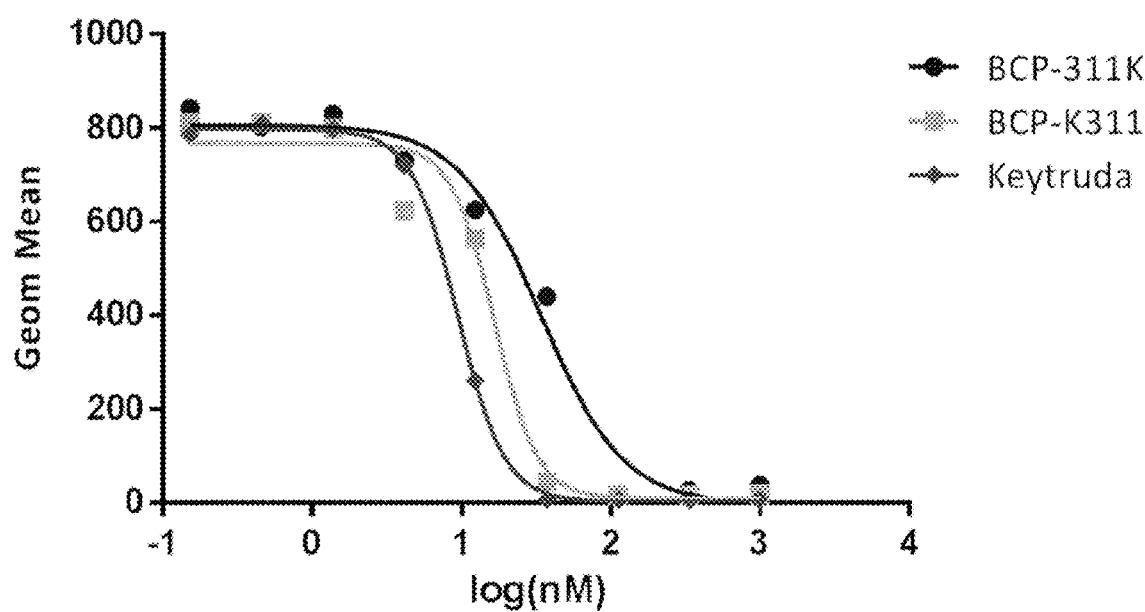
FIG. 14 depicts functional activity evaluation of designed bispecific CTLA-4×PD-1 antibodies for PD-1 targeting by FACS-based ligand competition assay, using PD-1 expressing stable cell line and biotin-labeled hPD-L1 Fc protein.

In order to evaluate the anti-PD-1 activity of the constructed CTLA-4×PD-1 bispecific antibodies, CHO cells expressing human PD-1 were dissociated from adherent culture flasks and mixed with varying concentrations of bispecific antibodies and a constant concentration of biotin-labeled hPD-L1-Fc fusion protein (both in a 96-well plate). The mixture was equilibrated for 30 minutes at room temperature, washed three times with FACS buffer (PBS containing 1% BSA). PE/Cy5 Streptavidin secondary antibody was then added and incubated for 15 minutes at room temperature. Cells were washed again with FACS buffer and analyzed by flow cytometry. Data were analyzed with Prism (GraphPad Software, San Diego, Calif.) using non-linear regression, and $IC_{50}$ values were calculated. As can be seen from FIG. 14, the competition assays demonstrated the abilities of the constructed bispecific antibodies in efficiently inhibiting PD-1/PD-L1 interactions at low concentrations (1-10 μg/ml). Consistent with the antibody affinity data (FIGS. 12A-12D), the functional activities of BCP-311K and BCP-K311 were comparable to their monoclonal anti-PD-1 antibody Keytruda® (FIG. 14).

Figure 15:
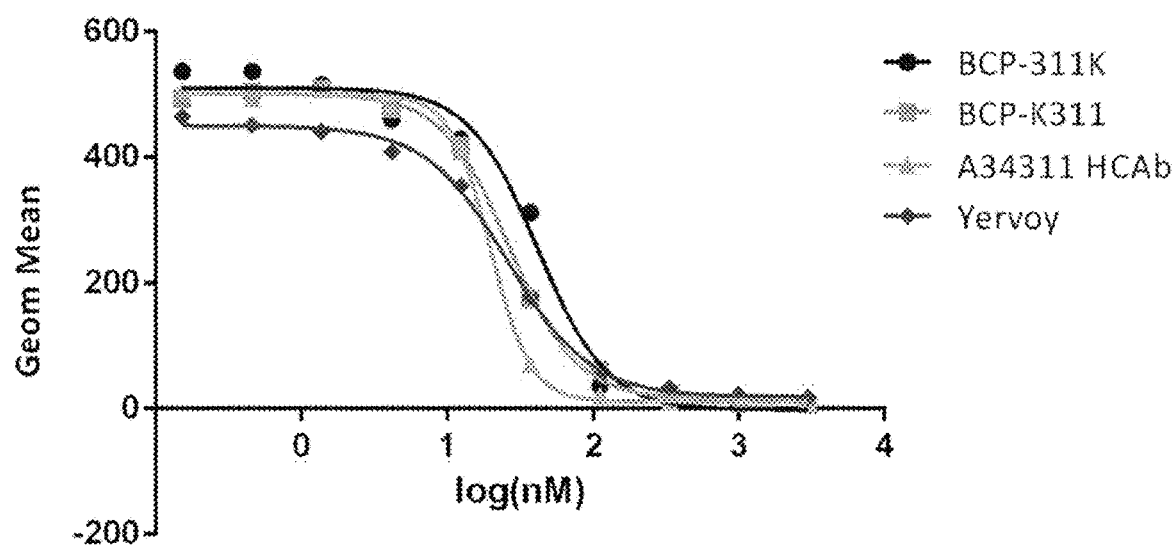
FIG. 15 depicts functional activity evaluation of designed bispecific CTLA-4×PD-1 antibodies for CTLA-4 targeting by FACS-based ligand competition assay, using B7-1 expressing stable cell lines and biotin-labeled hCTLA-4 Fc protein.
Figure 16A:
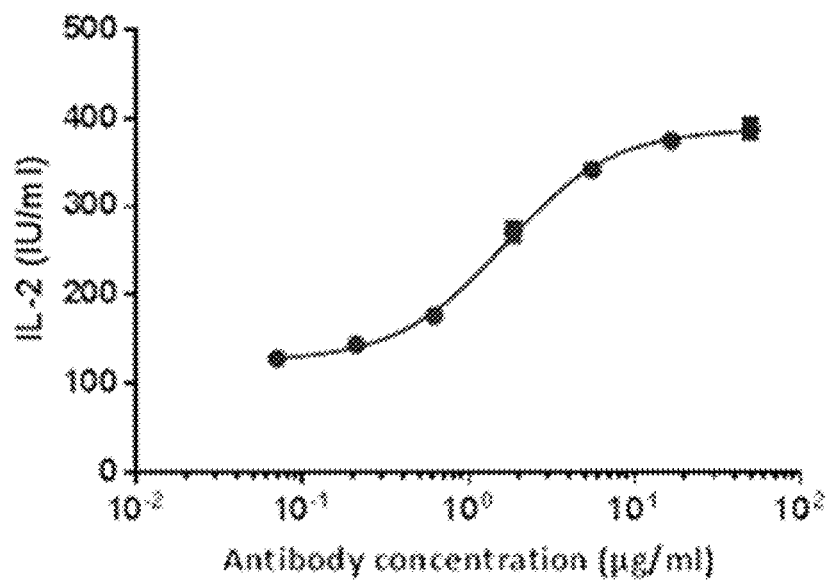
FIGS. 16A-16F depict functional activity evaluation of designed bispecific CTLA-4×PD-1 antibodies for CTLA-4 targeting by CTLA-4-based blockade assay. In-house expressed Yervoy biosimilar, Yervoy® antibody, and A34311 HCAb were used as a positive anti-CTLA-4 antibody control.
Figure 16B:
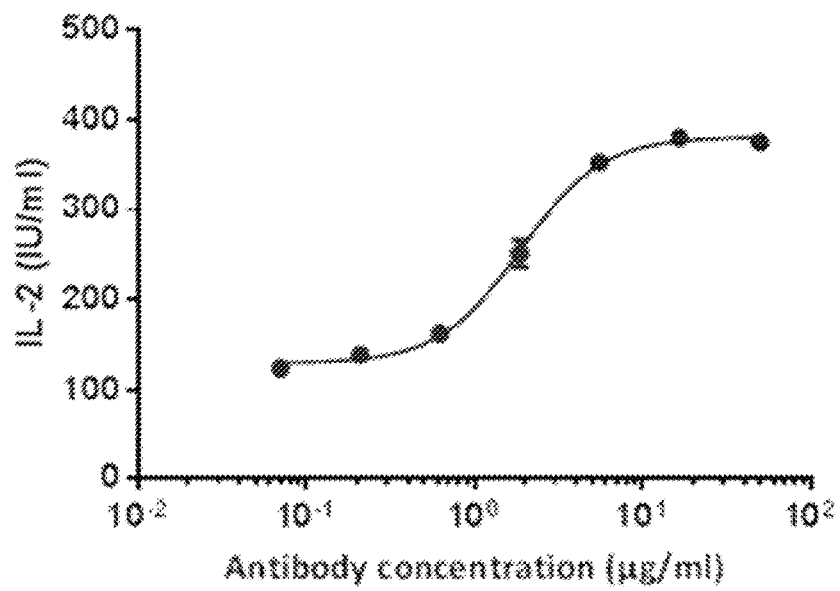
Figure 16C:
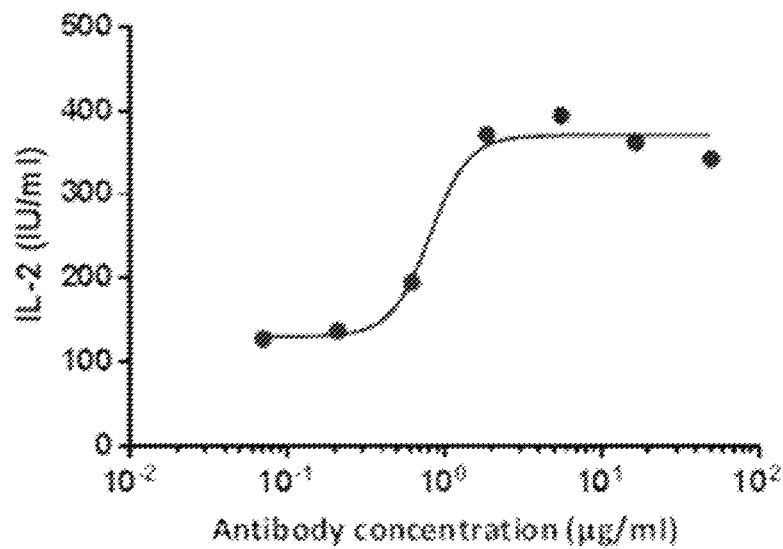
Figure 16D:
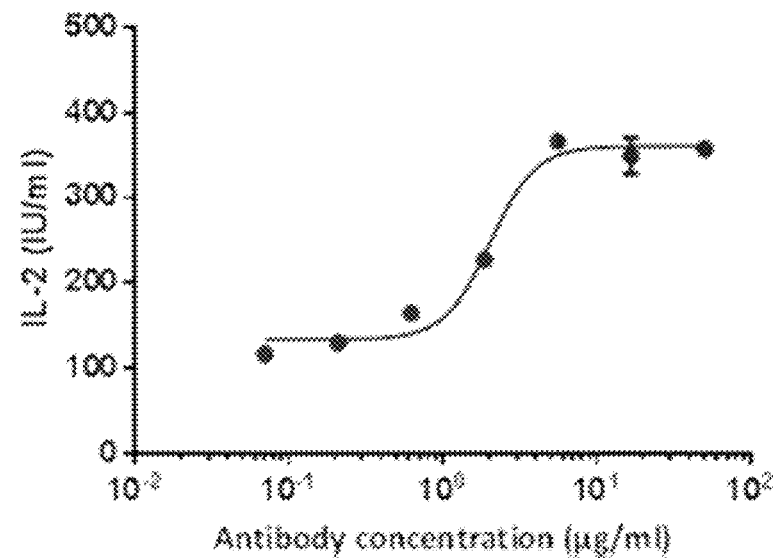
Figures 16E, 16F:
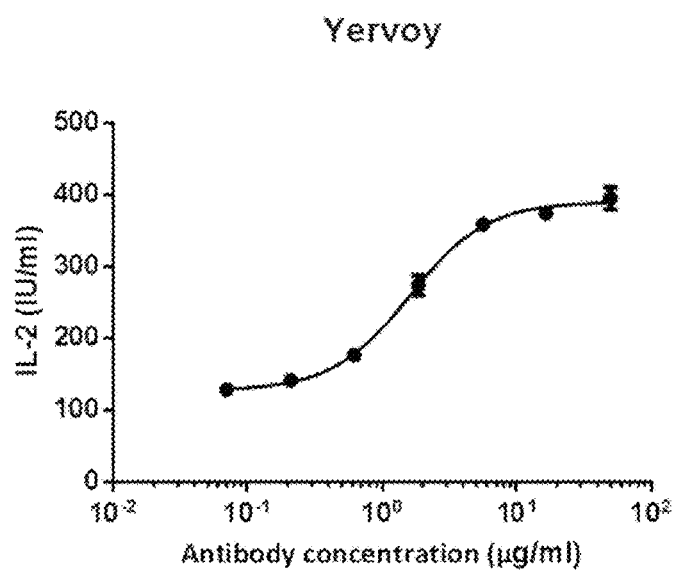
Figure 17A:
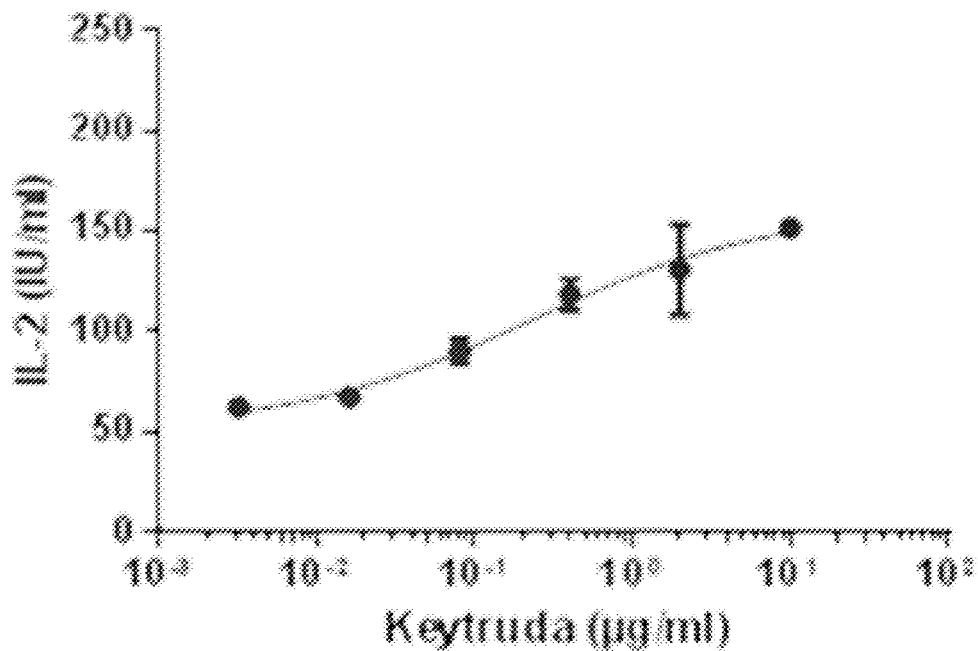
FIGS. 17A-17D depict functional activity evaluation of designed bispecific CTLA-4×PD-1 antibodies for PD-1 targeting by mixed lymphocyte reaction (MLR) assay. Keytruda® was used as a positive anti-PD-1 antibody control.
Figure 17B:
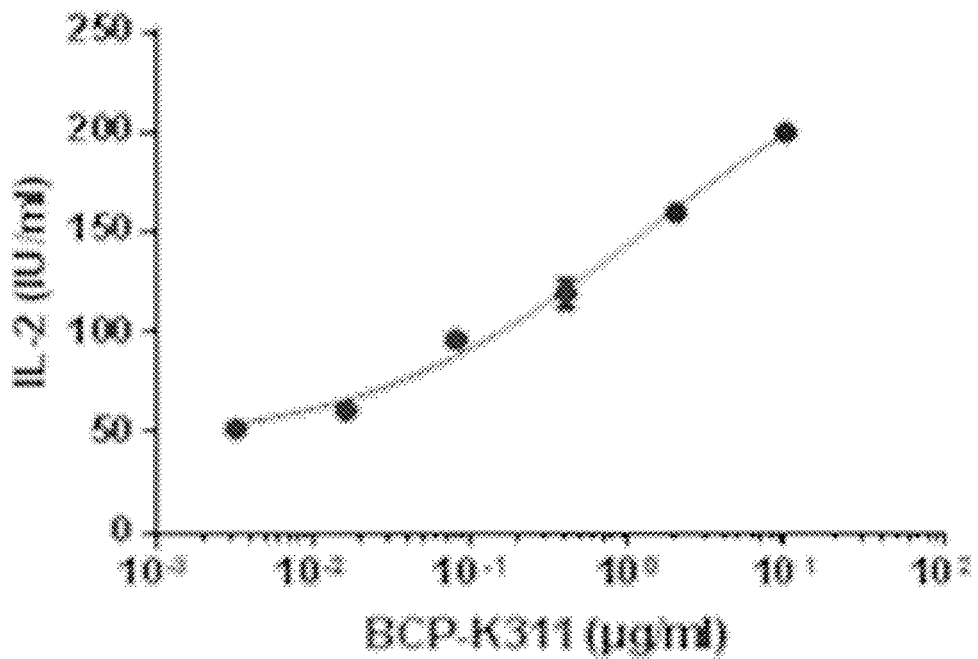
Figures 17C, 17D:
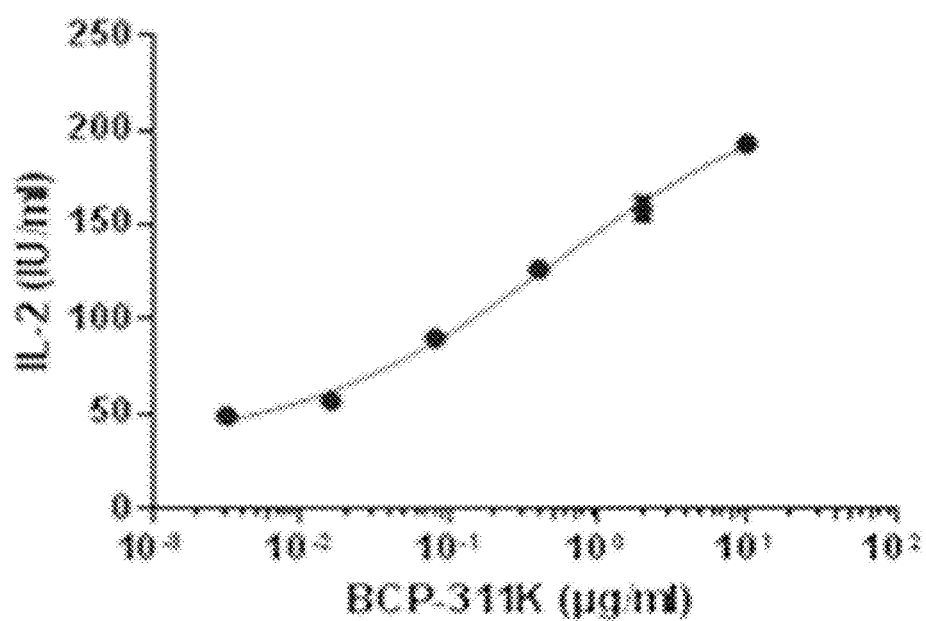

In order to evaluate the anti-CTLA-4 activity of the constructed CTLA-4×PD-1 bispecific antibodies, CHO cells expressing human B7-1 were dissociated from adherent culture flasks and mixed with varying concentrations of bispecific antibodies and a constant concentration of biotin-labeled hCTLA-4-Fc protein (both in a 96-well plate). The flow cytometry assay was carried out similarly as describe above. As can be seen from FIG. 15, the competition assays demonstrated the abilities of the constructed bispecific antibodies in efficiently inhibiting CTLA-4/B7-1 interactions at low concentrations (1-10 μg/ml). Consistent with the antibody affinity data (FIGS. 13A-13E), the functional activities of BCP-311K and BCP-K311 were comparable to A34311 HCAb and anti-CTLA-4 Yervoy® (FIG. 15).

In Vitro Functional Assays

Blockade of PD-1 and CTLA-4 pathways by the bispecific antibodies can be studied using a variety of bioassays that monitor T cell proliferation, IFN-γ release, IL-2 secretion or expression of reporter gene driven by signaling molecules in the PD-1 or CTLA-4 pathway.

For example, PD-1 inhibition by the bispecific antibodies can be studied by determining the IL-2 secretion level in mixed lymphocyte reactions (MLR) comprising target cells expressing PD-L1 and activated T cells, with bispecific antibodies provided at various concentrations.

Human CD4+ T cells and allogeneic monocytes were purified from PBMC using the isolation kits (Miltenyl Biotec). Monocytes were induced into dendritic cells. Each well contained $10^5$ CD4$^+$ T cells and $10^4$ allogeneic dendritic cells with a final working volume of 200 μl. CTLA-4×PD-1 bispecific antibodies were added into each well at different concentrations. No antibody was used as a background control. Human IgG4 was used as a negative control, and Keytruda® was used as the positive anti-PD-1 antibody control. After 72-hour incubation in 37° C./5% $CO_2$ incubator, 100 μl medium was taken from each testing well for IL-2 secretion measurement (Cisbio). Antibody concentration-dependent secretion of IL-2 in the MLRs was used to extract an $EC_{50}$ value for anti-PD-1 activity of the bispecific antibodies, and compared with the $EC_{50}$ value of the full-length anti-PD-1 antibody Keytruda®. Consistent with the FACS-based ligand competition assay results (FIG. 14), the functional activities of BCP-311K and BCP-K311 in targeting PD-1 were comparable to their monoclonal antibody Keytruda® (FIGS. 17A-17D).

Human CD4$^+$ T cells were purified from PBMC using the isolation kits (Miltenyl Biotec). Each well contained $10^5$ CD4+ T cells and $10^4$ CHO-K1/human CD80 (CHO-K1 stably expressing human CD80 (B7-1)) with a final working volume of 200 μl. CTLA-4×PD-1 bispecific antibodies were added into each well at different concentrations. No antibody was used as a background control. Human IgG4 was used as a negative control, and Yervoy® was used as a positive anti-CTLA-4 antibody control. hCTLA-4-Fc (GenScript, Z03373-50) was added into the system to initiate the reaction. After 24-hour incubation in 37° C./5% $CO_2$ incubator, 100 μl medium was taken from each testing well for IL-2 secretion measurement (Cisbio). Antibody concentration-dependent secretion of IL-2 by T cells in the CTLA-4 blockade bioassay was used to extract an $EC_{50}$ value for the anti-CTLA-4 activity of the bispecific antibodies, and compared to the $EC_{50}$ value of an in-house expressed biosimilar of the full-length anti-CTLA-4 Yervoy® ("Yervoy biosimilar"), Yervoy® antibody, and HCAb A34311 (FIGS. 16A-16F). Consistent with the FACS-based ligand competition assay results (FIG. 15), the functional activities of BCP-311K and BCP-K311 in targeting CTLA-4 were comparable to Yervoy biosimilar, Yervoy® antibody, and A34311 HCAb (FIGS. 16A-16F).

Figure 11A:
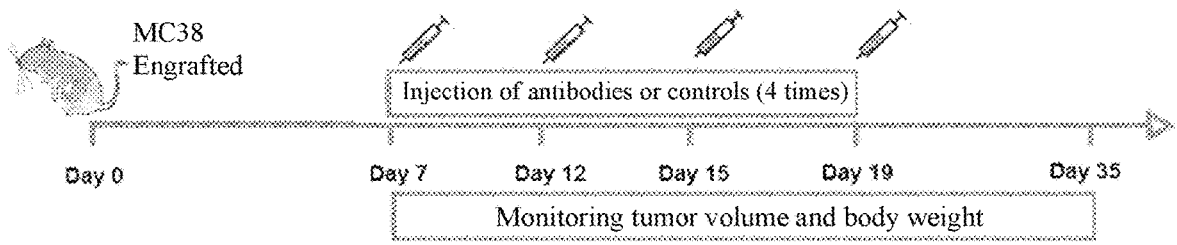
FIGS. 11A-11C depict in vivo efficacy study of A34311 HCAb and AS02640 HCAb using MC38 syngeneic mouse model.
Figure 11B:
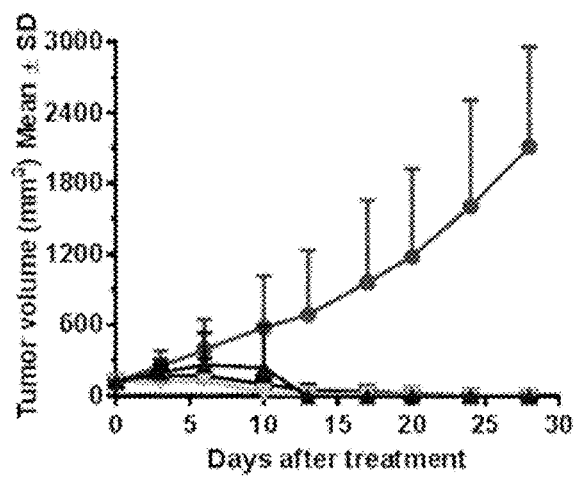
Figure 11C:
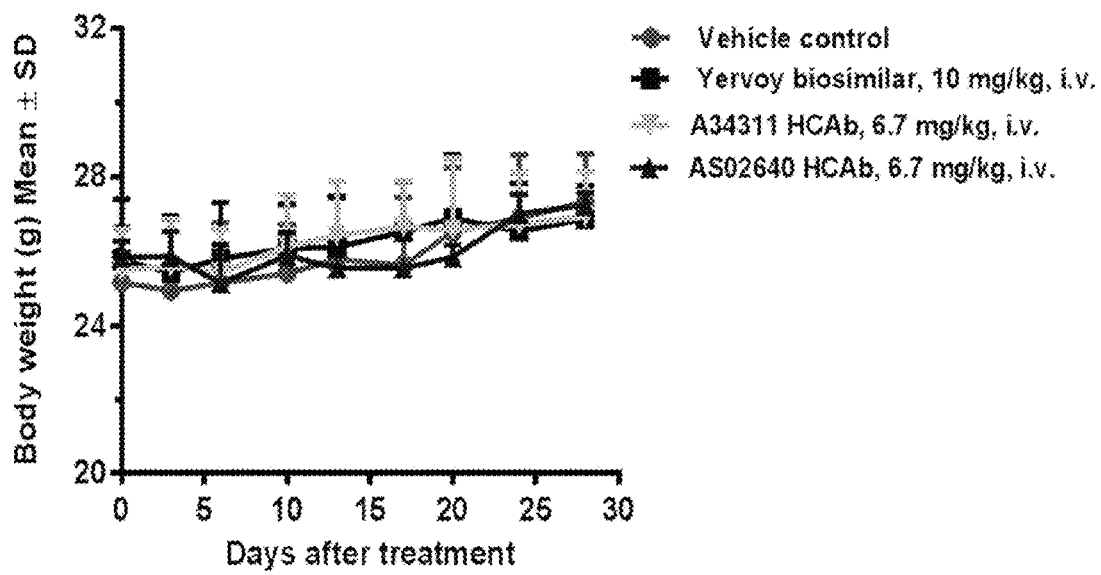
Figure 12A:
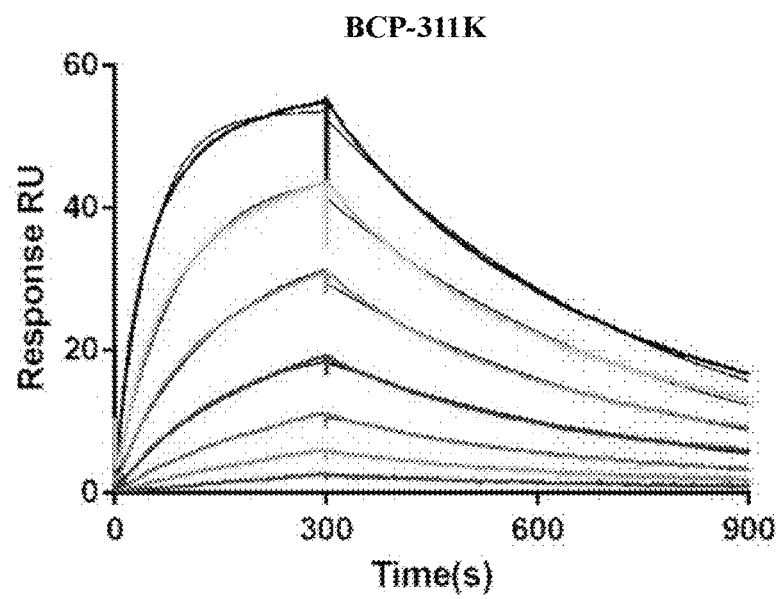
FIGS. 12A-12D depict affinity determination of two exemplary bispecific CTLA-4×PD-1 antibodies for PD-1 binding. Keytruda® was used as a positive control of anti-PD-1 antibody. The antibodies were immobilized onto the chip and PD-1-His protein was flowed as analyte at concentrations of 0.78, 1.56, 3.15, 6.25, 12.5, 25, 50, and 100 nM.
Figure 12B:
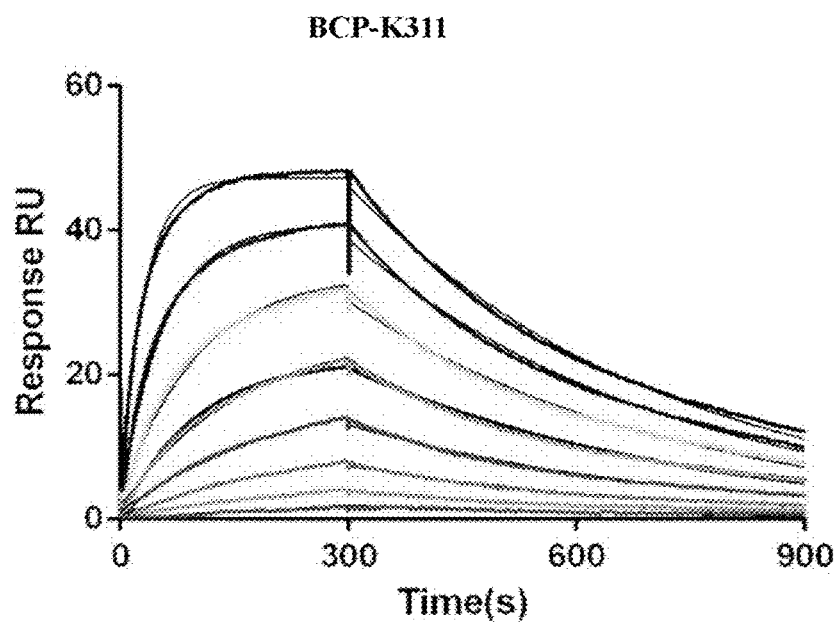
Figures 12C, 12D:
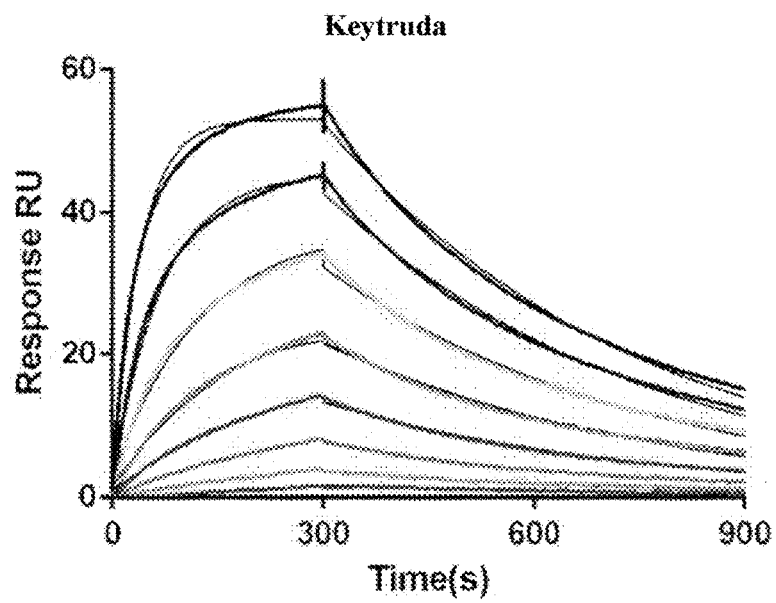

Example 5: In Vivo Efficacy Study of Anti-CTLA-4 HCAbs 6-8-week-old human CTLA-4 KI (knock-in) female C57/BL6 mice were shaved on their lower dorsum and s.c. injected with $1 \times 10^6$ colon cancer cell line MC38 in a 50 μL suspension of 75% (vol/vol) RPM' (Life Technologies) and 25% (vol/vol) medium-density matrigel (Corning). Mice whose tumors failed to engraft within 7 days by visual inspection were excluded from further study. Tumors were measured on a daily basis starting at day 7 after MC38 engraftment. Mice were individually sorted into treatment cohorts, and started to receive treatment only when tumors reached a threshold of 150 $mm^3$, about 10 days post engraftment in all cases. Digital caliper measurements and body-weight measurements were taken every three days for the duration of treatment (FIG. 11A). In the experiments, mice were given treatment intravenously for 16 days with 10 mg/kg in-house made Yervoy biosimilar antibody or comparable amount of anti-CTLA-4 HCAbs (A34311 HCAb or AS02640 HCAb). The treatment was conducted every 4 days. Mice injected with PBS served as negative control. As can be seen from FIG. 11B, both A34311 HCAb and its humanized clone AS02640 effectively controlled tumor growth in the MC38 syngeneic mice model, with a comparable functional activity to the biosimilar of the market drug Yervoy®. All these treatments did not affect the body weights of MC38 engrafted mice, as compared to the mock control (FIG. 11C).

Example 6: Anti-CTLA-4 HCAb Construction, Production and Characterization sdAbs with functional activities and slow off-rate from the above studies (A34311, A36566, A36922, AS07014, AS07189, and AS07745) and humanized anti-CTLA-4 variants (AS02636, AS02626, AS02640, A34311VH11, AS07014VH11, AS07014VH11G54, AS07014VH11SGA, AS07014VH11SGQ, AS07014VH11SGS, AS07189TKDVH11, AS07189TKDVH11F27, and AS07189TKDVH11FY) were selected for HCAb construction and production. DNA sequences of selected sdAbs were fused with DNA sequences of human IgG1 Fc to make HCAb constructs. The HCAb constructs were transfected into mammalian cell lines for HCAb expression. Secreted HCAbs in the condition medium were purified by protein A column.

Affinity Determination of HCAbs

Figure 23A:
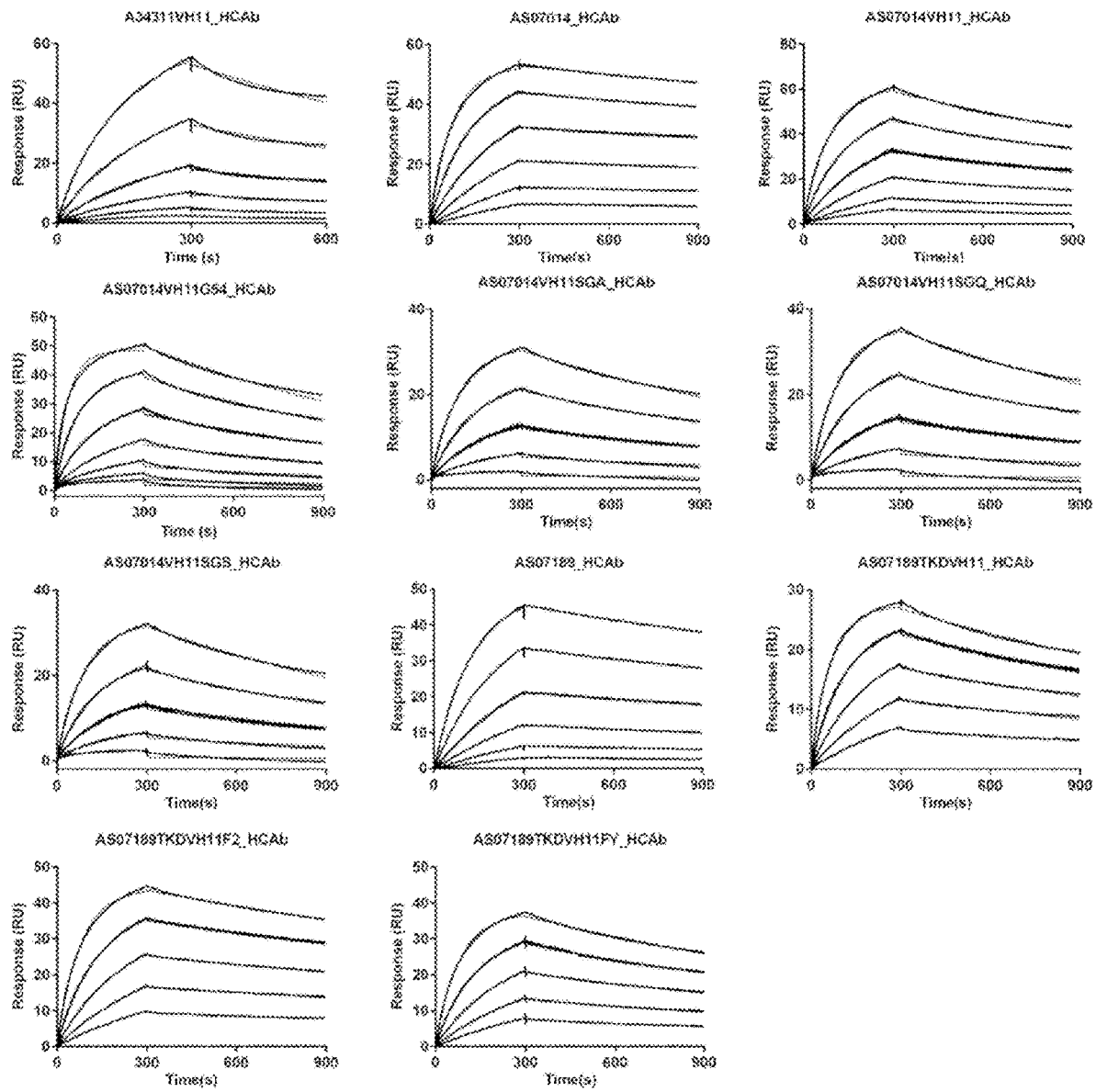
Figure 24A:
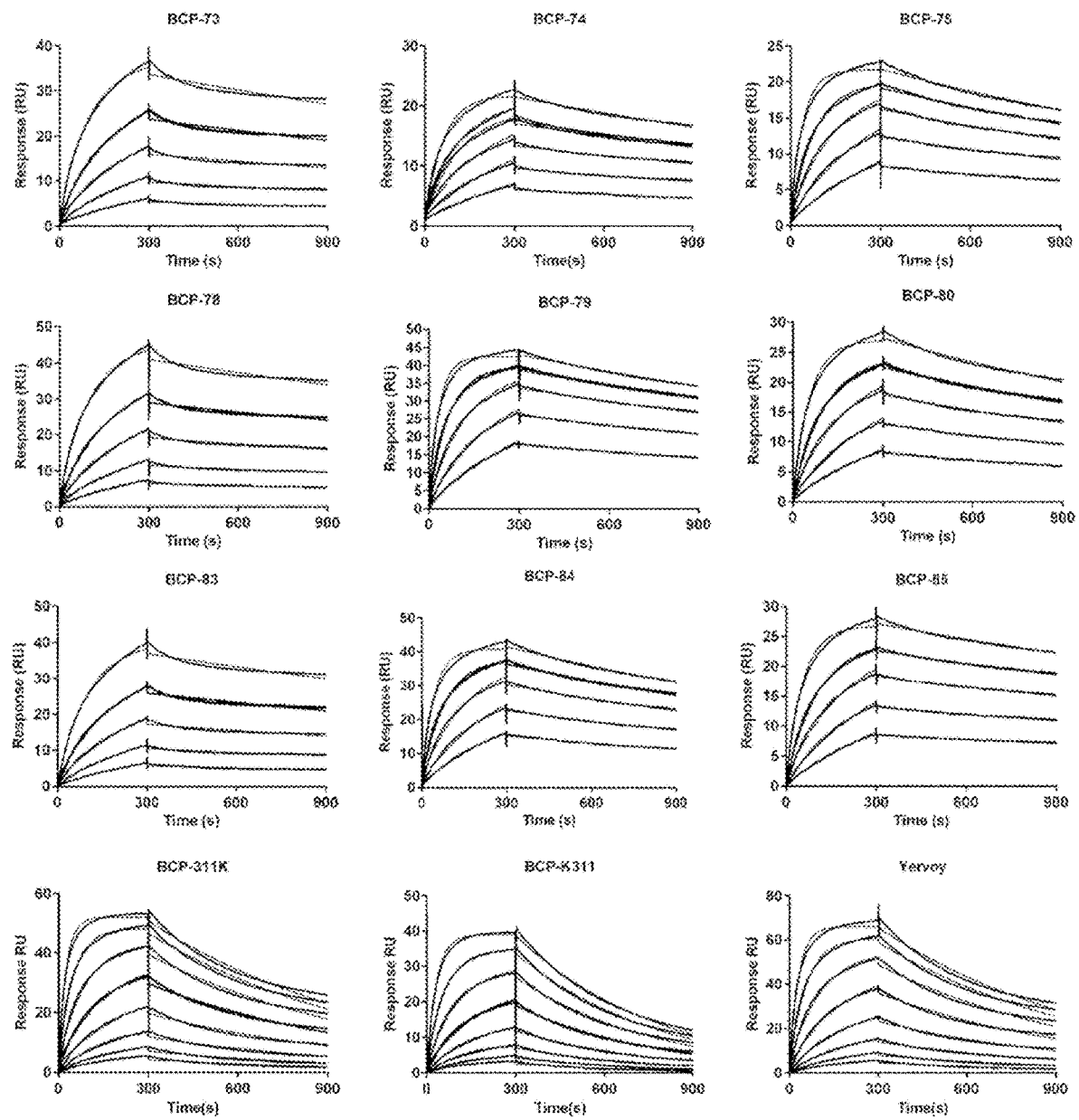
Figures 25A, 25B:
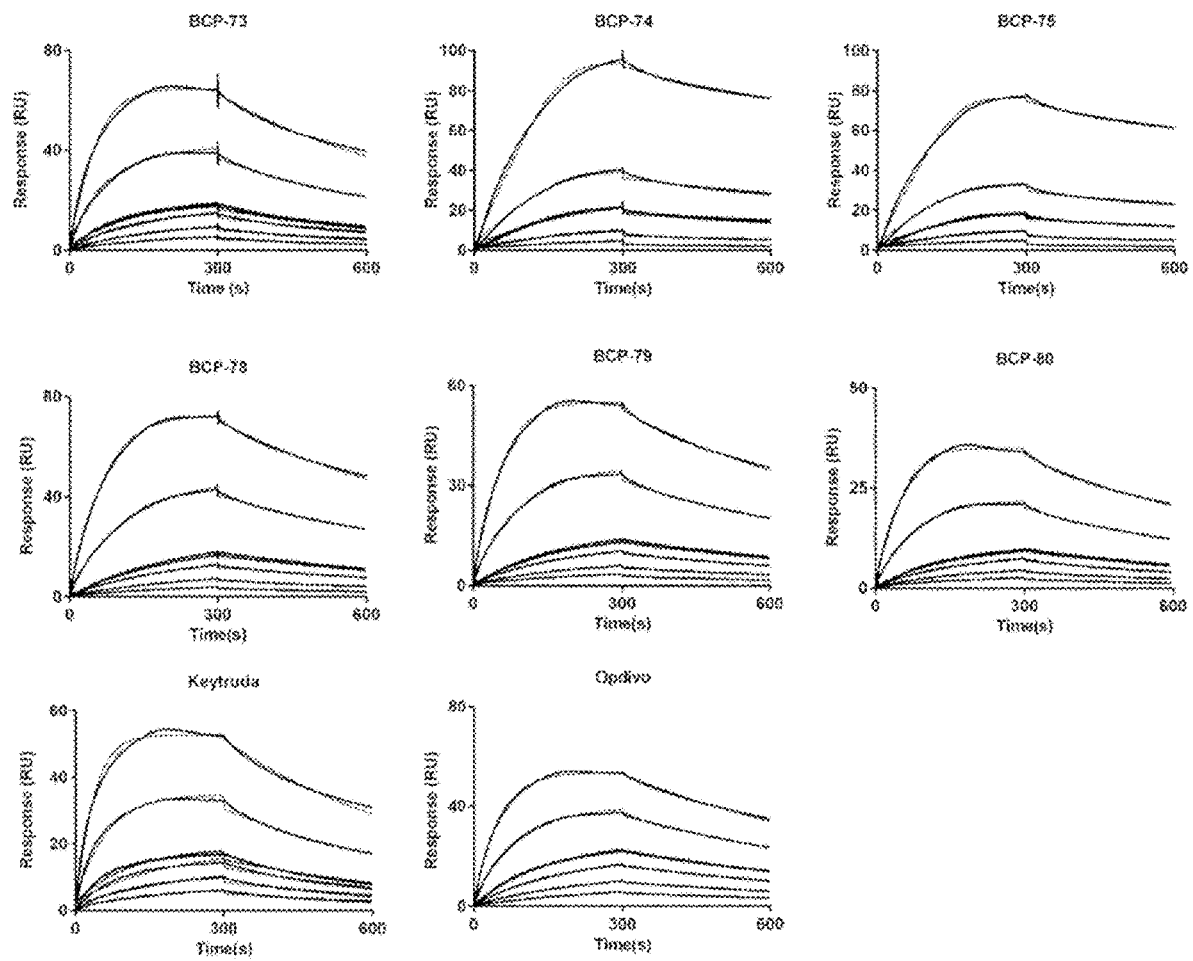
FIGS. 25A-25B depict the affinity determination of exemplary bispecific CTLA-4×PD-1 antibodies for binding to PD-1. Opdivo® was used as a positive control for anti-PD-1 antibody. Antibodies were immobilized onto the chip and the PD-1-His protein was flowed as analyte at concentrations of 3.125, 6.25, 12.5, 25, 50 and 100 nM. Kinetics data were summarized in FIG. 25B.
Figures 26A, 26B:
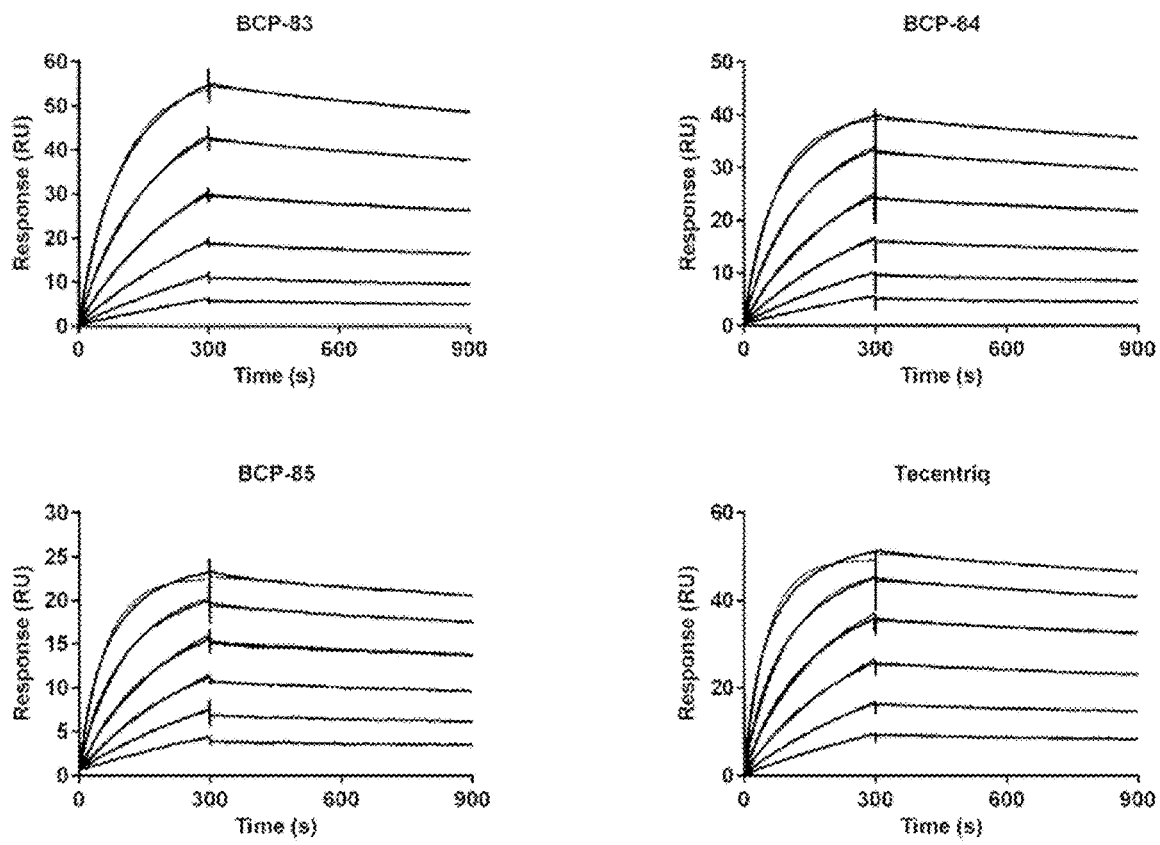
FIGS. 26A-26B depict the affinity determination of exemplary bispecific CTLA-4×PD-L1 antibodies for binding to PD-L1. Tecentriq® was used as a positive control for anti-PD-L1 antibody. was Antibodies were immobilized onto the chip and the PD-L1-His protein was flowed as analyte at concentrations of 1.56, 3.125, 6.25, 12.5, 25 and 50 nM. Kinetics data were summarized in FIG. 26B.

Binding kinetics of anti-CTLA-4 HCAbs were determined using a Surface Plasmon Resonance (SPR) biosensor, Biacore T200 (GE Healthcare). Antigen CTLA-4-His fusion protein was immobilized on the sensor chip. HCAbs were flowed as the analyte at concentrations of 5, 10, 20, 40, 80 and 160 nM. The data of dissociation ($k_d$) and association ($k_a$) rate constants were obtained using Biacore T200 evaluation software. The apparent equilibrium dissociation constants ($K_D$) were calculated from the ratio of $k_d/k_a$. As can be seen in FIGS. 23A-23B (also see FIG. 13D and FIG. 13E for A34311 HCAb), the binding affinities of most of humanized HCAbs (A34311VH11, AS07014VH11, AS07014VH11G54, AS07014VH11SGA, AS07014VH11SGQ, AS07014VH11SGS, AS07189TKDVH11, AS07189TKDVH11F27, and AS07189TKDVH11FY) were very close to those of the corresponding parental HCAbs (A34311 HCAb, AS07014 HCAb, and AS07189 HCAb), suggesting that antibody affinity was not affected after sdAb humanization.

CTLA-4-CHO Binding by FACS Analysis

Figure 32A:
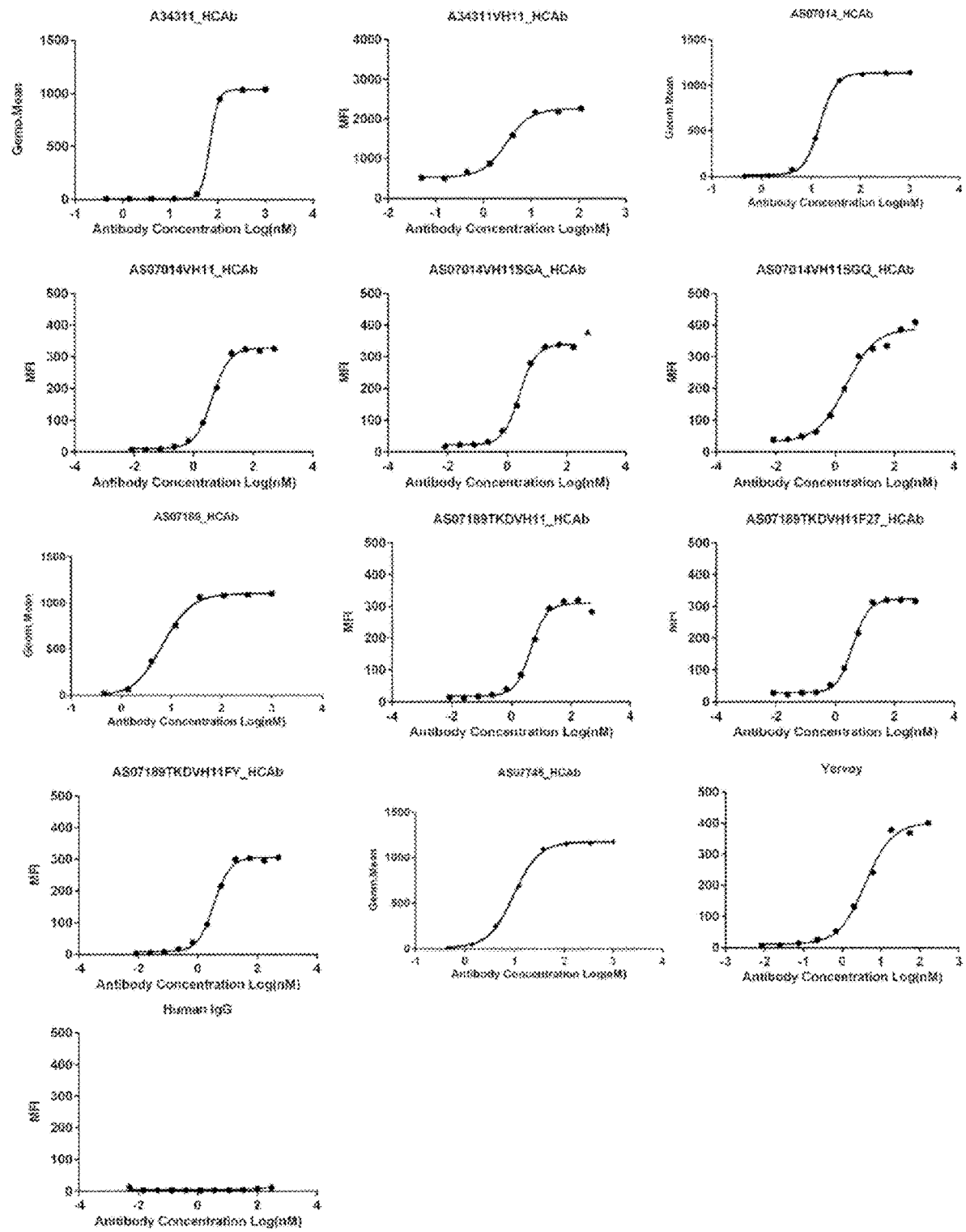

Binding of HCAbs to human CTLA-4 expressed on CHO cells was determined using a fluorescence-activated cell sorting (FACS)-based assay. CHO cells expressing human CTLA-4 were dissociated from adherent culture flasks and mixed with varying concentrations of antibodies (in a 96-well plate). Yervoy® was used as an anti-CTLA-4 antibody positive control. The mixture was equilibrated for 30 minutes at room temperature, then washed three times with FACS buffer (PBS containing 1% BSA). Fluorescein isothiocyanate (FITC)-conjugated anti-human κ antibody (Jackson ImmunoResearch) was then added and incubated for 15 minutes at room temperature, serving as a secondary antibody. Cells were washed again with FACS buffer and analyzed by flow cytometry. Data were analyzed with Prism (GraphPad Software, San Diego, Calif.) using non-linear regression, and $EC_{50}$ values were calculated. As shown in FIGS. 32A-32B, the FACS binding assays demonstrated that various HCAbs exhibited comparable binding ability to Yervoy®.

Inhibition of Ligand Binding by FACS Analysis

Purified anti-CTLA-4 HCAbs (A34311 HCAb, A36566 HCAb, A36922 HCAb, AS07014 HCAb, and AS07189 HCAb) and humanized anti-CTLA-4 HCAbs (A34311VH11 HCAb, AS07014VH11 HCAb, AS07189TKDVH11 HCAb, AS02636 HCAb, AS02626 HCAb, AS02640 HCAb, AS07014VH11G54 HCAb, AS07014VH11SGA HCAb, AS07014VH11SGQ HCAb, AS07014VH11SGS HCAb, AS07189TKDVH11F27 HCAb, and AS07189TKDVH11FY HCAb) were tested for their abilities to inhibit CTLA-4-B7-1 binding by FACS analysis, similarly as described in Example 1. Yervoy® was used as a positive control. As can be seen from FIGS. 18A-18J (results for other constructs are not shown), the competition assays demonstrated the ability of anti-CTLA-4 HCAbs in efficiently inhibiting CTLA4-B7-1 interactions at low concentrations (1-10 μg/ml). And according to $IC_{50}$ of the FACS data, A34311 HCAb, A36566 HCAb, A36922 HCAb, and most of humanized anti-CTLA-4 HCAbs (A34311VH11 HCAb, AS07014VH11 HCAb, AS07189TKDVH11 HCAb, AS02640 HCAb, AS07014VH11G54 HCAb, AS07014VH11SGA HCAb, AS07014VH11SGQ HCAb, AS07014VH11SGS HCAb, AS07189TKDVH11F27 HCAb, and AS07189TKDVH11FY HCAb) showed comparable functional activity as the market drug Yervoy® (FIG. 18J; results for other constructs are not shown).

CTLA-4 Based Blockade Assay

Figure 28A:
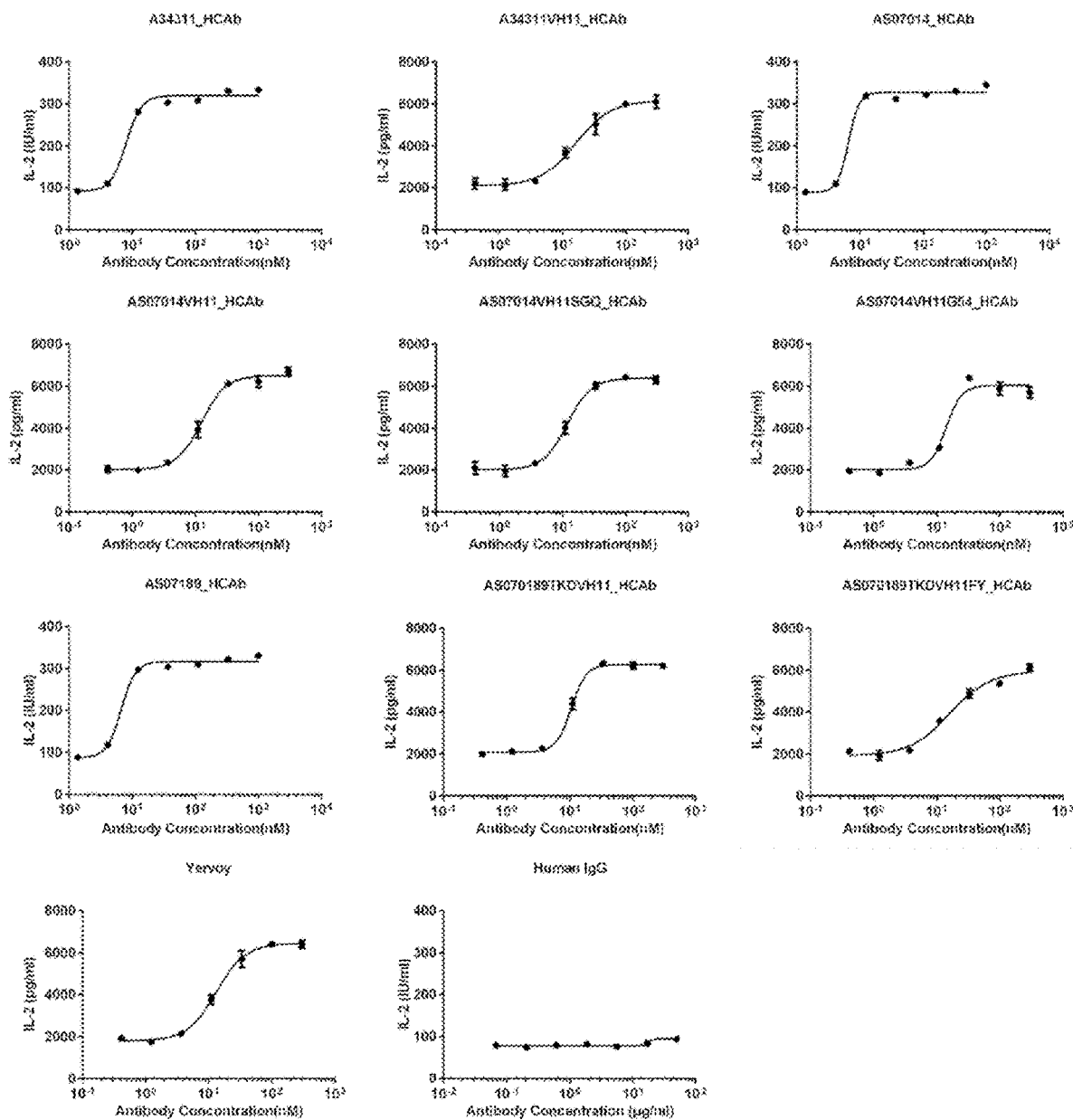

CTLA-4 based blockade assay was performed similarly as described in Example 1. Human IgG was employed as a negative control. As can be seen from FIGS. 28A-28B (test results for other constructed HCAbs are not shown), A34311 HCAb, AS07014 HCAb, AS07189 HCAb, and most of humanized HCAbs (A34311VH11 HCAb, AS07014VH11 HCAb, AS07189TKDVH11 HCAb, AS07014VH11G54 HCAb, AS07014VH11SGQ HCAb, and AS07189TKDVH11FY HCAb) showed comparable functional activity as the market drug Yervoy® in inhibiting the binding between CTLA-4 and B7-1, consistent with the FACS-based ligand competition assay results described above (FIGS. 18A-18J).

Example 7: In Vivo Efficacy Study of Anti-CTLA-4 HCAbs

Figure 36A:
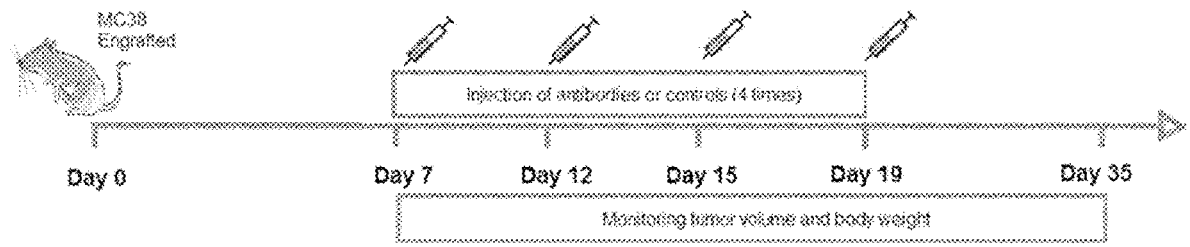
FIGS. 36A-36C depict in vivo efficacy study of A34311 HCAb, humanized AS07014VH11 HCAb and humanized AS07189TKDVH11 HCAb using MC38 syngeneic mouse model in CTLA-4 KI mice. A Yervoy biosimilar was used as a positive anti-CTLA-4 antibody control.
Figure 36B:
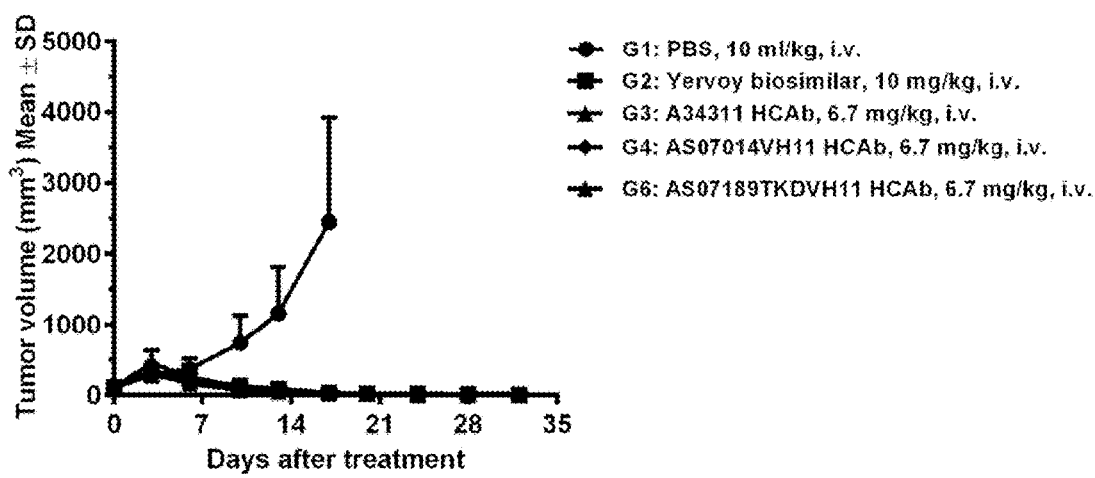
Figure 36C:
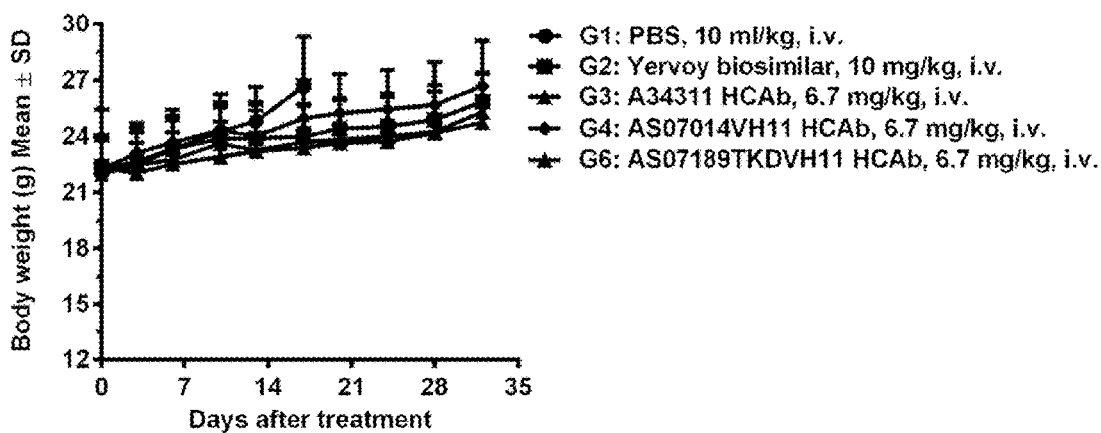

A34311 HCAb, humanized AS07014VH11 HCAb, and humanized AS07189TKDVH11 HCAb were tested for their in vivo efficacy. 6-8-week-old human CTLA-4 KI (knock-in) female C57/BL6 mice were shaved on their lower dorsum and s.c. injected with $1\times10^6$ colon cancer cell line MC38 in a 50 µL suspension of 75% (vol/vol) RPM1 (Life Technologies) and 25% (vol/vol) medium-density matrigel (Corning). Mice whose tumors failed to engraft within 7 days by visual inspection were excluded from further study. Tumors were measured on a daily basis starting at day 7 after MC38 engraftment. Mice were individually sorted into treatment cohorts, and started to receive treatment only when tumors reached a threshold of 150 mm³, about 10 days post engraftment in all cases. Digital caliper measurements and bodyweight measurements were taken every three days for the duration of treatment (FIG. 36A). In the experiments, mice were given treatment intravenously for 16 days with 10 mg/kg in-house made Yervoy biosimilar antibody or comparable amount of anti-CTLA-4 HCAbs. The treatment was conducted every 4 days. Mice injected with PBS served as negative control. As can be seen from FIG. 36B, A34311 HCAb, AS07014VH11 HCAb, and AS07189TKDVH11 HCAb effectively controlled tumor growth in the MC38 syngeneic mice model, with a comparable functional activity to the biosimilar of the market drug Yervoy®. All these treatments did not affect the body weights of MC38 engrafted mice, as compared to the mock control (injected PBS; FIG. 36C).

Example 8: Generation and Characterization of Bispecific Antibodies Comprising the Anti-CTLA-4 sdAbs Construction of CTLA-4×PD-1 and CTLA-4×PD-L1 Bispecific Antigen Binding Proteins (BABP)

Bispecific antibodies can be constructed with an anti-CTLA-4 sdAb fused to a full-length antibody, or scFv or Fab region of the full-length antibody with Fc region in the C-terminus, such as anti-PD-1 antibodies, e.g., Keytruda® (Pembrolizumab), Opdivo® (nivolumab), PD1BMmin, or anti-PD-L1 antibodies, e.g., Tecentriq® (Atezolizumab), IMFINZI™ (Durvalumab). The anti-CTLA-4 sdAb can be connected to the full-length antibody (or scFv or Fab region of the full-length antibody with Fc region in the C-terminus) via a linker (such as 9-amino acid Gly/Ser linker (9GS linker), human IgG1 (hIgG1) hinge, or mutated hIgG1 hinge), or without a linker. The anti-CTLA-4 sdAb can be fused to at least one of the heavy chains, at least one of the light chains, or both heavy chain and light chain.

This example describes the construction and expression of exemplary CTLA-4×PD-1 and CTLA-4×PD-L1 bispecific antigen binding proteins (BABP). 104 constructs were designed. 68 constructs were expressed (Constructs 1-43, 63-74, 87-94, and 95-99) and 36 constructs are expressed (Constructs 44-62, 75-86, and 100-104), each comprising two sets of polypeptide chains as described below (also see Table 4, Table 7 and Table 9 for CTLA-4×PD-1 BABP sequences, Table 5 and Table 8 for CTLA-4×PD-L1 BABP sequences). Briefly, BABP comprising an anti-CTLA-4 sdAb (A34311, AS02640, A34311VH11, A34311VH2, A34311VH2F53, A34311VH11F53, AS07014VH11, AS07189TKDVH11, AS07014VH11SGQ, AS07189TKDVH11FY, or AS07189TKDVH21FY) fused to an anti-PD-1 full-length antibody (e.g., Keytruda® (Pembrolizumab), Opdivo® (nivolumab), PD1BMmin) or anti-PD-L1 full-length antibody (e.g., Tecentriq® (Atezolizumab), IMFINZI™ (Durvalumab)), or scFv or Fab region of the full-length antibody, with or without a linker (9-amino acid Gly/Ser linker, human IgG1 hinge linker, or mutated hIgG1 hinge linker), were constructed (Constructs 1-43, 63-74, 87-94, and 95-99), or are constructed (Constructs 44-62, 75-86, and 100-104).

Constructs 1-5 (BCP-73, BCP-74, BCP-75, BCP-90, BCP-91):

The first polypeptide comprises from the N-terminus to the C-terminus: the $V_HH$ domain of an anti-CTLA-4 sdAb (A34311VH11 for BCP-73, AS07014VH11 for BCP-74, AS07189TKDVH11 for BCP-75, AS07014VH11SGQ for BCP-90, and AS07189TKDVH11FY for BCP-91), a peptide linker (mutated human IgG1 (hIgG1) hinge region, e.g., SEQ ID NO: 307), the heavy chain variable domain $V_H$ of pembrolizumab, and heavy chain constant domains of IgG4. The second polypeptide comprises from the N-terminus to the C-terminus: the light chain variable domain $V_L$ of pembrolizumab, and antibody kappa light chain $C_L$ domain. The five BABPs have the format of FIG. 40.

Constructs 6-10 (BCP-78, BCP-79, BCP-80, BCP-94, BCP-95):

The first polypeptide comprises from the N-terminus to the C-terminus: the $V_HH$ domain of an anti-CTLA-4 sdAb (A34311VH11 for BCP-78, AS07014VH11 for BCP-79, AS07189TKDVH11 for BCP-80, AS07014VH11SGQ for BCP-94, and AS07189TKDVH11FY for BCP-95), a peptide linker (mutated hIgG1 hinge region, e.g., SEQ ID NO: 307), the heavy chain variable domain $V_H$ of nivolumab, and heavy chain constant domains of IgG4. The second polypeptide comprises from the N-terminus to the C-terminus: the light chain variable domain $V_L$ of nivolumab, and antibody kappa light chain $C_L$ domain. The five BABPs have the format of FIG. 40.

Constructs 11-19 (BCP-100, BCP-101, BCP-103/104/105/106/107/108/109):

The first polypeptide comprises from the N-terminus to the C terminus: the $V_HH$ domain of an anti-CTLA-4 sdAb (AS07189TKDVH11FY for BCP-100, AS07014VH11SGQ for BCP-101, AS07189TKDVH21FY for BCP-103, A34311VH2 for BCP-104, A34311VH2F53 for BCP-105, A34311VH11 for BCP-106, A34311VH11F53 for BCP-107, AS07014VH11 for BCP-108, and AS07189TKDVH11 for BCP-109), a peptide linker (mutated hIgG1 hinge region, e.g., SEQ ID NO: 307), the heavy chain variable domain $V_H$ of PD1BMmin, and heavy chain constant domains of IgG4 (see SEQ ID NO: 308 for PD1BMmin heavy chain amino acid sequence). The second polypeptide comprises from the N-terminus to the C-terminus: the light chain variable domain $V_L$ of PD1BMmin, and antibody kappa light chain $C_L$ domain (see SEQ ID NO: 309 for PD1BMmin light chain amino acid sequence). The nine BABPs have the format of FIG. 40.

Constructs 20-25 (BCP-311K, A34311-hIgG1 hinge-Keytruda, A34311-Keytruda, AS02640-9GS-Keytruda, AS02640-hIgG1 Hinge-Keytruda, AS02640-Keytruda):

The first polypeptide comprises from the N-terminus to the C-terminus: the $V_HH$ domain of an anti-CTLA-4 sdAb (A34311 for BCP-311K, A34311-hIgG1 hinge-Keytruda, and A34311-Keytruda, AS02640 for AS02640-9GS-Keytruda, AS02640-hIgG1 hinge-Keytruda, and AS02640-

Keytruda), an optional peptide linker (SEQ ID NO: 162 for BCP-311K and AS02640-9GS-Keytruda, SEQ ID NO: 163 for A34311-hIgG1 hinge-Keytruda and AS02640-hIgG1 hinge-Keytruda, no linker for A34311-Keytruda and AS02640-Keytruda), the heavy chain variable domain $V_H$ of pembrolizumab, and heavy chain constant domains of IgG4. The second polypeptide comprises from the N-terminus to the C-terminus: the light chain variable domain $V_L$ of pembrolizumab, and antibody kappa light chain $C_L$ domain. The six BABPs have the format of FIG. 40.

Constructs 26-31 (A34311-9GS-Opdivo, A34311-hIgG1 hinge-Opdivo, A34311-Opdivo, AS02640-9GS-Opdivo, AS02640-hIgG1 hinge-Opdivo, AS02640-Opdivo):

The first polypeptide comprises from the N-terminus to the C-terminus: the $V_H$H domain of an anti-CTLA-4 sdAb (A34311 for A34311-9GS-Opdivo, A34311-hIgG1 hinge-Opdivo, and A34311-Opdivo, AS02640 for AS02640-9GS-Opdivo, AS02640-hIgG1 hinge-Opdivo, and AS02640-Opdivo), an optional peptide linker (SEQ ID NO: 162 for A34311-9GS-Opdivo and AS02640-9GS-Opdivo, SEQ ID NO: 163 for A34311-hIgG1 hinge-Opdivo and AS02640-hIgG1 hinge-Opdivo, no linker for A34311-Opdivo and AS02640-Opdivo), the heavy chain variable domain $V_H$ of nivolumab, and heavy chain constant domains of IgG4. The second polypeptide comprises from the N-terminus to the C-terminus: the light chain variable domain $V_L$ of nivolumab, and antibody kappa light chain $C_L$ domain. The six BABPs have the format of FIG. 40.

Constructs 32-37 (A34311-9GS-Tecentriq, A34311-hIgG1 hinge-Tecentriq, A34311-Tecentriq, AS02640-9GS-Tecentriq, AS02640-hIgG1 hinge-Tecentriq, AS02640-Tecentriq):

The first polypeptide comprises from the N-terminus to the C-terminus: the $V_H$H domain of an anti-CTLA-4 sdAb (A34311 for A34311-9GS-Tecentriq, A34311-hIgG1 hinge-Tecentriq, and A34311-Tecentriq, AS02640 for AS02640-9GS-Tecentriq, AS02640-hIgG1 hinge-Tecentriq, and AS02640-Tecentriq), an optional peptide linker (SEQ ID NO: 162 for A34311-9GS-Tecentriq and AS02640-9GS-Tecentriq, SEQ ID NO: 163 for A34311-hIgG1 hinge-Tecentriq and AS02640-hIgG1 hinge-Tecentriq, no linker for A34311-Tecentriq and AS02640-Tecentriq), the heavy chain variable domain $V_H$ of atezolizumab, and heavy chain constant domains of non-glycosylated IgG1. The second polypeptide comprises from the N-terminus to the C-terminus: the light chain variable domain $V_L$ of atezolizumab, and antibody kappa light chain $C_L$ domain. The six BABPs have the format of FIG. 40.

Constructs 38-43 (A34311-9GS-Durvalumab, A34311-hIgG1 hinge-Durvalumab, A34311-Durvalumab, AS02640-9GS-Durvalumab, AS02640-hIgG1 hinge-Durvalumab, AS02640-Durvalumab):

The first polypeptide comprises from the N-terminus to the C-terminus: the $V_H$H domain of an anti-CTLA-4 sdAb (A34311 for A34311-9GS-Durvalumab, A34311-hIgG1 hinge-Durvalumab, and A34311-Durvalumab, AS02640 for AS02640-9GS-Durvalumab, AS02640-hIgG1 hinge-Durvalumab, and AS02640-Durvalumab), an optional peptide linker (SEQ ID NO: 162 for A34311-9GS-Durvalumab and AS02640-9GS-Durvalumab, SEQ ID NO: 163 for A34311-hIgG1 hinge-Durvalumab and AS02640-hIgG1 hinge-Durvalumab, no linker for A34311-Durvalumab and AS02640-Durvalumab), the heavy chain variable domain $V_H$ of Durvalumab, and effectless heavy chain constant domains of IgG1 (engineered IgG1 with no ADCC and CDC activity). The second polypeptide comprises from the N-terminus to the C-terminus: the light chain variable domain $V_L$ of Durvalumab, and antibody kappa light chain $C_L$ domain. The six BABPs have the format of FIG. 40.

Constructs 44-48 (BCP-73C, BCP-74C, BCP-75C, BCP-90C, BCP-91C):

The first polypeptide comprises from the N-terminus to the C-terminus: the heavy chain variable domain $V_H$ of pembrolizumab, heavy chain constant domains of IgG4, a peptide linker (mutated hIgG1 hinge region, e.g., SEQ ID NO: 307), and the $V_H$H domain of an anti-CTLA-4 sdAb (A34311VH11 for BCP-73C, AS07014VH11 for BCP-74C, AS07189TKDVH11 for BCP-75C, AS07014VH11SGQ for BCP-90C, and AS07189TKDVH11FY for BCP-91C). The second polypeptide comprises from the N-terminus to the C-terminus: the light chain variable domain $V_L$ of pembrolizumab, and antibody kappa light chain $C_L$ domain. The five BABPs have the format of FIG. 41.

Constructs 49-53 (BCP-78C, BCP-79C, BCP-80C, BCP-94C, BCP-95C):

The first polypeptide comprises from the N-terminus to the C-terminus: the heavy chain variable domain $V_H$ of nivolumab, heavy chain constant domains of IgG4, a peptide linker (mutated hIgG1 hinge region, e.g., SEQ ID NO: 307), and the $V_H$H domain of an anti-CTLA-4 sdAb (A34311VH11 for BCP-78C, AS07014VH11 for BCP-79C, AS07189TKDVH11 for BCP-80C, AS07014VH11SGQ for BCP-94C, and AS07189TKDVH11FY for BCP-95C). The second polypeptide comprises from the N-terminus to the C-terminus: the light chain variable domain $V_L$ of nivolumab, and antibody kappa light chain $C_L$ domain. The five BABPs have the format of FIG. 41.

Constructs 54-62 (BCP-100C, BCP-101C, BCP-103C/104C/105C/106C/107C/108C/109C):

The first polypeptide comprises from the N-terminus to the C-terminus: the heavy chain variable domain $V_H$ of PD1BMmin, heavy chain constant domains of IgG4 (see SEQ ID NO: 308 for PD1BMmin heavy chain amino acid sequence), a peptide linker (mutated hIgG1 hinge region, e.g., SEQ ID NO: 307), and the $V_H$H domain of an anti-CTLA-4 sdAb (AS07189TKDVH11FY for BCP-100C, AS07014VH11SGQ for BCP-101C, AS07189TKDVH21FY for BCP-103C, A34311VH2 for BCP-104C, A34311VH2F53 for BCP-105C, A34311VH11 for BCP-106C, A34311VH11F53 for BCP-107C, AS07014VH11 for BCP-108C, and AS07189TKDVH11 for BCP-109C). The second polypeptide comprises from the N-terminus to the C-terminus: the light chain variable domain $V_L$ of PD1BMmin, and antibody kappa light chain $C_L$ domain (see SEQ ID NO: 309 for PD1BMmin light chain amino acid sequence). The nine BABPs have the format of FIG. 41.

Constructs 63-68 (BCP-K311 (BCP-2), Keytruda-hIgG1 hinge-A34311, Keytruda-A34311, Keytruda-9GS-AS02640, Keytruda-hIgG1 hinge-AS02640, Keytruda-AS02640):

The first polypeptide comprises from the N-terminus to the C-terminus: the heavy chain variable domain $V_H$ of pembrolizumab, heavy chain constant domains of IgG4, an optional peptide linker (SEQ ID NO: 162 for BCP-K311 and Keytruda-9GS-AS02640, SEQ ID NO: 163 for Keytruda-hIgG1 hinge-A34311 and Keytruda-hIgG1 hinge-AS02640, no linker for Keytruda-A34311 and Keytruda-AS02640), and the $V_H$H domain of an anti-CTLA-4 sdAb (A34311 for BCP-K311, Keytruda-hIgG1 hinge-A34311, and Keytruda-A34311, AS02640 for Keytruda-9GS-AS02640, Keytruda-hIgG1 hinge-AS02640, and Keytruda-AS02640). The second polypeptide comprises from the N-terminus to the C-terminus: the light chain variable domain VL of pembrolizumab, and antibody kappa light chain $C_L$ domain. The six BABPs have the format of FIG. 41.

Constructs 69-74 (Opdivo-9GS-A34311, Opdivo-hIgG1 hinge-A34311, Opdivo-A34311, Opdivo-9GS-AS02640, Opdivo-hIgG1 hinge-AS02640, Opdivo-AS02640):

The first polypeptide comprises from the N-terminus to the C-terminus: the heavy chain variable domain $V_H$ of nivolumab, heavy chain constant domains of IgG4, an optional peptide linker (SEQ ID NO: 162 for Opdivo-9GS-A34311 and Opdivo-9GS-AS02640, SEQ ID NO: 163 for Opdivo-hIgG1 hinge-A34311 and Opdivo-hIgG1 hinge-AS02640, no linker for Opdivo-A34311 and Opdivo-AS02640), and the $V_H$H domain of an anti-CTLA-4 sdAb (A34311 for Opdivo-9GS-A34311, Opdivo-hIgG1 hinge-A34311, and Opdivo-A34311, AS02640 for Opdivo-9GS-AS02640, Opdivo-hIgG1 hinge-AS02640, and Opdivo-AS02640). The second polypeptide comprises from the N-terminus to the C-terminus: the light chain variable domain $V_L$ of nivolumab, and antibody kappa light chain CL domain. The six BABPs have the format of FIG. 41.

Constructs 75-80 (Tecentriq-9GS-A34311, Tecentriq-hIgG1 hinge-A34311, Tecentriq-A34311, Tecentriq-9GS-AS02640, Tecentriq-hIgG1 hinge-AS02640, Tecentriq-AS02640):

The first polypeptide comprises from the N-terminus to the C-terminus: the heavy chain variable domain $V_H$ of atezolizumab, heavy chain constant domains of non-glycosylated IgG1, an optional peptide linker (SEQ ID NO: 162 for Tecentriq-9GS-A34311 and Tecentriq-9GS-AS02640, SEQ ID NO: 163 for Tecentriq-hIgG1 hinge-A34311 and Tecentriq-hIgG1 hinge-AS02640, no linker for Tecentriq-A34311 and Tecentriq-AS02640), and the $V_H$H domain of an anti-CTLA-4 sdAb (A34311 for Tecentriq-9GS-A34311, Tecentriq-hIgG1 hinge-A34311, and Tecentriq-A34311, AS02640 for Tecentriq-9GS-AS02640, Tecentriq-hIgG1 hinge-AS02640, and Tecentriq-AS02640). The second polypeptide comprises from the N-terminus to the C-terminus: the light chain variable domain $V_L$ of atezolizumab, and antibody kappa light chain $C_L$ domain. The six BABPs have the format of FIG. 41.

Constructs 81-86 (Durvalumab-9GS-A34311, Durvalumab-hIgG1 hinge-A34311, Durvalumab-A34311, Durvalumab-9GS-AS02640, Durvalumab-hIgG1 hinge-AS02640, Durvalumab-AS02640):

The first polypeptide comprises from the N-terminus to the C terminus: the heavy chain variable domain $V_H$ of Durvalumab, effectless heavy chain constant domains of IgG1 (engineered IgG1 with no ADCC and CDC activity), an optional peptide linker (SEQ ID NO: 162 for Durvalumab-9GS-A34311 and Durvalumab-9GS-AS02640, SEQ ID NO: 163 for Durvalumab-hIgG1 hinge-A34311 and Durvalumab-hIgG1 hinge-AS02640, no linker for Durvalumab-A34311 and Durvalumab-AS02640), and the $V_H$H domain of an anti-CTLA-4 sdAb (A34311 for Durvalumab-9GS-A34311, Durvalumab-hIgG1 hinge-A34311, and Durvalumab-A34311, AS02640 for Durvalumab-9GS-AS02640, Durvalumab-hIgG1 hinge-AS02640, and Durvalumab-AS02640). The second polypeptide comprises from the N-terminus to the C-terminus: the light chain variable domain $V_L$ of Durvalumab, and antibody kappa light chain $C_L$ domain. The six BABPs have the format of FIG. 41.

Construct 87 (BCP-16):

The first polypeptide comprises from the N-terminus to the C-terminus: the heavy chain variable domain $V_H$ of pembrolizumab, and heavy chain constant domains of IgG4. The second polypeptide comprises from the N-terminus to the C-terminus: the $V_H$H domain of an anti-CTLA-4 sdAb (A34311), a peptide linker (human IgG1 hinge region, e.g., SEQ ID NO: 163), the light chain variable domain $V_L$ of pembrolizumab, and antibody kappa light chain $C_L$ domain. BCP-16 has the format of FIG. 42.

Construct 88 (BCP-17):

The first polypeptide comprises from the N-terminus to the C-terminus: the heavy chain variable domain $V_H$ of pembrolizumab, and heavy chain constant domains of IgG4. The second polypeptide comprises from the N-terminus to the C-terminus: the light chain variable domain $V_L$ of pembrolizumab, antibody kappa light chain $C_L$ domain, a peptide linker (SEQ ID NO: 163), the $V_H$H domain of an anti-CTLA-4 sdAb (A34311). BCP-17 has the format of FIG. 43.

Construct 89 (BCP-31):

The first polypeptide comprises from the N-terminus to the C-terminus: the $V_H$H domain of an anti-CTLA-4 sdAb (A34311), a peptide linker (9GS linker, e.g., SEQ ID NO: 162), the heavy chain variable domain $V_H$ of pembrolizumab, and heavy chain constant domains of IgG4. The second polypeptide comprises from the N-terminus to the C-terminus: the $V_H$H domain of an anti-CTLA-4 sdAb (A34311), a peptide linker (9GS linker, e.g., SEQ ID NO: 162), the light chain variable domain $V_L$ of pembrolizumab, and antibody kappa light chain $C_L$ domain. BCP-31 has the format of FIG. 44.

Construct 90 (BCP-32):

The first polypeptide comprises from the N-terminus to the C-terminus: the $V_H$H domain of an anti-CTLA-4 sdAb (A34311), a peptide linker (9GS linker, e.g., SEQ ID NO: 162), the $V_H$H domain of an anti-CTLA-4 sdAb (A34311), a peptide linker (SEQ ID NO: 162), the heavy chain variable domain $V_H$ of pembrolizumab, and heavy chain constant domains of IgG4. The second polypeptide comprises from the N-terminus to the C-terminus: the light chain variable domain $V_L$ of pembrolizumab, and antibody kappa light chain $C_L$ domain. BCP-32 has the format of FIG. 45.

Construct 91 (BCP-33):

The first polypeptide comprises from the N-terminus to the C-terminus: the heavy chain variable domain $V_H$ of pembrolizumab, constant $C_H1$ region of IgG1, a peptide linker (SEQ ID NO: 163), the $V_H$H domain of an anti-CTLA-4 sdAb (A34311), and the Fc region of IgG1. The second polypeptide comprises from the N-terminus to the C-terminus: the light chain variable domain $V_L$ of pembrolizumab, and antibody kappa light chain $C_L$ domain. BCP-33 has the format of FIG. 46.

Construct 92 (BCP-34):

The polypeptide comprises from the N-terminus to the C-terminus: the light chain variable domain $V_L$ of pembrolizumab, a peptide linker (GGGGSGGGGSGGGGS, SEQ ID NO: 365), the heavy chain variable domain $V_H$ of pembrolizumab, a peptide linker (SEQ ID NO: 163), the $V_H$H domain of an anti-CTLA-4 sdAb (A34311), and Fc region of IgG1. BCP-34 has the format of FIG. 47.

Construct 93 (BCP-35):

The first polypeptide comprises from the N-terminus to the C-terminus: the heavy chain variable domain $V_H$ of pembrolizumab, constant $C_H1$ region of IgG4, a peptide linker (SEQ ID NO: 163), the $V_H$H domain of an anti-CTLA-4 sdAb (A34311), constant $C_H1$ region of IgG4, and the Fc region of IgG4. The second polypeptide comprises from the N-terminus to the C-terminus: the light chain variable domain $V_L$ of pembrolizumab, antibody kappa light chain $C_L$ domain, a peptide linker (SEQ ID NO: 163), the $V_HH$ domain of an anti-CTLA-4 sdAb (A34311), and antibody kappa light chain $C_L$ domain. BCP-35 has the format of FIG. 48.

Construct 94 (BCP-36):

The first polypeptide comprises from the N-terminus to the C-terminus: the light chain variable domain $V_L$ of pembrolizumab, a peptide linker (SEQ ID NO: 365), the heavy chain variable domain $V_H$ of pembrolizumab, a peptide linker (SEQ ID NO: 163), the $V_HH$ domain of an anti-CTLA-4 sdAb (A34311), constant $C_H1$ region of IgG1, and Fc region of IgG1. The second polypeptide comprises from the N-terminus to the C-terminus: the $V_HH$ domain of an anti-CTLA-4 sdAb (A34311), and antibody kappa light chain $C_L$ domain. BCP-36 has the format of FIG. 49.

Constructs 95-99 (BCP-83, BCP-84, BCP-85, BCP-92, BCP-93):

The first polypeptide comprises from the N-terminus to the C-terminus: the $V_HH$ domain of an anti-CTLA-4 sdAb (A34311VH11 for BCP-83, AS07014VH11 for BCP-84, AS07189TKDVH11 for BCP-85, AS07014VH11SGQ for BCP-92, and AS07189TKDVH11FY for BCP-93), a peptide linker (mutated hIgG1 hinge region, e.g., SEQ ID NO: 307), the heavy chain variable domain $V_H$ of atezolizumab, and heavy chain constant domains of non-glycosylated IgG1. The second polypeptide comprises from the N-terminus to the C-terminus: the light chain variable domain $V_L$ of atezolizumab, and antibody kappa light chain $C_L$ domain. The five BABPs have the format of FIG. 40.

Constructs 100-104 (BCP-83C, BCP-84C, BCP-85C, BCP-92C, BCP-93C):

The first polypeptide comprises from the N-terminus to the C-terminus: the heavy chain variable domain $V_H$ of atezolizumab, heavy chain constant domains of non-glycosylated IgG1, a peptide linker (mutated hIgG1 hinge region, e.g., SEQ ID NO: 307), and the $V_HH$ domain of an anti-CTLA-4 sdAb (A34311VH11 for BCP-83C, AS07014VH11 for BCP-84C, AS07189TKDVH11 for BCP-85C, AS07014VH11SGQ for BCP-92C, and AS07189TKDVH11FY for BCP-93C). The second polypeptide comprises from the N-terminus to the C-terminus: the light chain variable domain $V_L$ of atezolizumab, and antibody kappa light chain $C_L$ domain. The five BABPs have the format of FIG. 41.

Each BABP described above (except Construct 92 (BCP-34)) consists of two copies of the first polypeptide and two copies of the second polypeptide. Construct 92 (BCP-34) consists of two copies of the polypeptide. An S228P mutation can be introduced into the IgG4 Fc region to inhibit Fab arm exchange. Furthermore, the Fc region of the BABPs may be swapped with an IgG Fc of a different isotype, for example, the IgG1 isotype or IgG4 isotype. The Fc region of IgG4 isotype has low binding affinity to FcγRs, thus can be employed in some embodiments to avoid ADCC-mediated depletion of PD-1/PD-L1 or CTLA-4 positive cells. In some embodiments, the BABPs comprise wild-type IgG1 with ADCC.

BABP Production

The plasmids of 68 BABP constructs (Constructs 1-43, 63-74, 87-94, and 95-99) were prepared and transiently expressed in CHO-3E7 cells. Of which, 19 exemplary BABP constructs (BCP-311K, BCP-K311 (BCP-2), BCP-73, BCP-74, BCP-75, BCP-78, BCP-79, BCP-80, BCP-16, BCP-17, BCP-31, BCP-32, BCP-33, BCP-34, BCP-35, BCP-36, BCP-83, BCP-84, and BCP-85) were purified by one-step protein A chromatography and stored in PBS buffer, pH 7.2. The composition and purity of the purified BABPs were analyzed by SDS-PAGE under both reduced and non-reduced conditions. The sizes of the polypeptide chains as well as the full-length BABP molecules were consistent with their calculated molecular mass based on the amino acid sequences. To further study the physical properties of the BABPs in solution, size exclusion chromatography was used to analyze each protein. All BABPs exhibited a single major peak, demonstrating physical homogeneity as monomeric molecules, i.e., non-aggregated BABP molecules each being a dimeric protein consisting of 4 polypeptide chains, including 2 copies of the first polypeptide chain and 2 copies of the second polypeptide chain (BCP-34 being a dimeric protein consisting of 2 copies of the polypeptide chains). A summary of some of the data is shown in Table 10. Data in Table 10 demonstrated that the production levels of most BABPs were comparable to those of the regular monoclonal antibodies, indicating that the BABPs can be expressed efficiently in mammalian cells.

The plasmids of 36 BABP constructs (Constructs 44-62, 75-86, and 100-104) are prepared and transiently expressed in CHO-3E7 cells, followed by purification with one-step protein A chromatography.

TABLE 10

Production of exemplary
CTLA-4 × PD-1 and CTLA-4 × PD-L1 BABPs

| BABP | Host cell | Transient expression (mg/L) | Monomeric molecule (HPLC) | Storage buffer |
|---|---|---|---|---|
| BCP-73 | CHO-3E7 | 13.15 | 94.20% | PBS, pH7.2 |
| BCP-74 | CHO-3E7 | 13.45 | 94.00% | PBS, pH7.2 |
| BCP-75 | CHO-3E7 | 14.55 | 94.70% | PBS, pH7.2 |
| BCP-78 | CHO-3E7 | 106.3 | 96.60% | PBS, pH7.2 |
| BCP-79 | CHO-3E7 | 122.4 | 93.60% | PBS, pH7.2 |
| BCP-80 | CHO-3E7 | 102.4 | 94.10% | PBS, pH7.2 |
| BCP-2 | CHO-3E7 | 20.5 | 97.90% | PBS, pH7.2 |
| BCP-16 | CHO-3E7 | 4.65 | 98.30% | PBS, pH7.2 |
| BCP-17 | CHO-3E7 | 12.35 | 92.30% | PBS, pH7.2 |
| BCP-31 | CHO-3E7 | 31.05 | 95.20% | PBS, pH7.2 |
| BCP-32 | CHO-3E7 | 29.7 | 93.90% | PBS, pH7.2 |
| BCP-33 | CHO-3E7 | 2.45 | 94.80% | PBS, pH7.2 |
| BCP-34 | CHO-3E7 | 3.6 | 99.50% | PBS, pH7.2 |
| BCP-35 | CHO-3E7 | 11.25 | 95.40% | PBS, pH7.2 |
| BCP-36 | CHO-3E7 | 0.45 | 92.90% | PBS, pH7.2 |
| BCP-84 | CHO-3E7 | 74.4 | 95.34% | PBS, pH7.2 |
| BCP-85 | CHO-3E7 | 77.4 | 96.94% | PBS, pH7.2 |

Stability Analysis

The thermal stability of various BABPs was investigated using a MICROCAL™ VP-Capillary Differential Scanning Calorimetry (DSC, Microcal, Northampton, Mass., USA, Malvern Instruments). Approximately 370 μl of each BABP (1 mg/ml) and its corresponding buffer was added to a 96-well plate according to MICROCAL™ VP-Capillary DSC user's manual. A detergent cleaning program was included between each sample run to keep the reference and sample cells clean. All samples were scanned from 20° C. to 100° C. with a scan rate of 90° C./h (1.5° C./min) in a passive mode. The collected data were analyzed using the VP-Capillary DSC software based on ORGIN™ 7.0 (Northampton, Mass., USA). All thermograms were controlled and baseline subtracted to obtain the apparent midpoint ($T_m$) and apparent enthalpy (ΔH) of protein unfolding. The unfolding Midpoint Temperatures ($T_m$) of various BABPs are shown in Table 11 (DSC).

The formation of larger protein aggregates during heating was followed using dynamic light scattering (DLS). A temperature ramp from 25° C. to 75° C. with temperature interval at about 0.75° C. was performed for samples at 1.5 mg/ml using the DYNAPRO® NANOSTAR® plate reader (Wyatt, Santa Barbara, Calif.). 20 µl of each BABP sample was added to a WYATT® disposable cuvette followed by covering the sample with 10 µl of mineral oil (Sigma 8410) to prevent evaporation. Triplicate measurements (5 acquisitions/each measurement) were averaged for each BABP sample. In the duration of an experiment with the chosen temperature interval, the thermal scan rate was calculated to be 1.5° C./min. Each sample was measured while the temperature was continuously heated until the target temperature reached 75° C. (~40 min). The aggregation temperature ($T_{agg}$) was analyzed with onset analysis method in the DYNAMICS™ 7.6.0.48 software (Wyatt, Santa Barbara, Calif.). The measured aggregation onset temperatures ($T_{agg}$) of various BABPs are shown in Table 11.

TABLE 11

DSC and DLS analysis of exemplary CTLA-4 × PD-1 and CTLA-4 × PD-L1 BABPs

| Construct | $T_m$ (° C.) | $T_{agg}$ (° C.) |
|---|---|---|
| BCP-73 | 69.5 | 69.2 |
| BCP-74 | 68.9 | 70.8 |
| BCP-75 | 67.6 | 70.2 |
| Biosimilar pembrolizumab | 67.6 | 69.6 |
| BCP-78 | 68.9 | 70.8 |
| BCP-79 | 67.9 | 70.6 |
| BCP-80 | 67.8 | 69.2 |
| Biosimilar nivolumab | 65.2 | 67.6 |
| BCP-84 | 70.8 | 70.3 |
| BCP-85 | 70.3 | 69.6 |
| Biosimilar atezolizumab | 71.8 | 69.2 |

As shown in Table 11, $T_m$ and $T_{agg}$ of BCP-73, BCP-74, and BCP-75 were comparable to those of biosimilar pembrolizumab (e.g., compared to Keytruda®), $T_m$ and $T_{agg}$ of BCP-78, BCP-79, and BCP-80 were comparable to those of biosimilar nivolumab (e.g., compared to Opdivo®), and $T_m$ and $T_{agg}$ of BCP-84 and BCP-85 were comparable to those of biosimilar atezolizumab (e.g., compared to TECENTRIQ®).

BABP samples at concentration of >50 mg/ml in Histidine buffer (pH 6.0) were incubated at constant temperatures of 4° C., 25° C. and 37° C. for 7 days. A similar set of samples was also freeze-thawed five times. Fractions of intact full monomeric molecules of all samples were evaluated by SEC-HPLC, and the data were recorded and analyzed using CHROMELEON™ software supplied by the manufacturer. Table 12 showed that the exemplary BABPs retained greater than 90% integrity under the thermo-challenged conditions.

TABLE 12

Stability analysis of exemplary CTLA-4 × PD-1 BABPs

| | Monomeric molecule (by SEC-HPLC) | | | | |
|---|---|---|---|---|---|
| Construct | Starting | 4° C. | 25° C. | 37° C. | after 5 freeze-thaw cycles |
| BCP-73 | 94.2% | 94.8% | 94.5% | 93.7% | 92.3% |
| BCP-74 | 94.0% | 94.2% | 93.9% | 93.8% | 92.5% |
| BCP-75 | 94.7% | 95.1% | 94.5% | 94.1% | 93.4% |
| BCP-78 | 96.6% | 97.2% | 95.8% | 95.2% | 94.7% |
| BCP-79 | 93.6% | 94.3% | 93.6% | 93.1% | 92.1% |
| BCP-80 | 94.1% | 92.8% | 93.5% | 92.7% | 91.8% |

Solubility Analysis

To characterize the solubility of purified BABPs, 10 mg of each BABP at 1 mg/ml was added to MICROCON®-30 kDa centrifugal concentrators (EMD Millipore) in volumes of ~2.5 ml and centrifuged at 4000×g (4° C.). The volumes were periodically checked and protein was added to the concentrators until the remaining protein solutions had been consumed. Concentration proceeded for 2 h until either the volume reached ~20 µl or stopped decreasing. The concentration was determined by performing UV measurements of samples obtained by diluting 1 µl of concentrated BABP into 199 µl of each respective buffer. The samples were evaluated for aggregation using analytical SEC-HPLC after diluting BABPs to 1 mg/ml in their respective buffers. Table 13 showed that the BABPs retained full integrity under these stressed conditions.

The solubility of purified BABPs was also measured using a cross-interaction chromatography (CIC) column. Murine polyclonal antibodies purified from pooled mouse serum were purchased from Sigma-Aldrich (15381). Murine polyclonal antibodies were coupled to the resin matrix at ~30 mg/mL. Purified BABPs in PBS buffer were injected to the murine IgG-coupled column and the control column, respectively, with concentrations ranging from 0.05 to 0.20 mg/mL. The retention times were used to calculate the retention factor k' values reported in Table 13: k'=(Vr−Vo)/Vo=(Tr−Tm)/Tm. Vr represents the elution volume of the sample on the protein coupled column, Vo represents the elution volume from a control column, Tr represents the retention time on the protein coupled column, and Tm represents the retention time on the control column. A number of samples were run twice on the same column. Antibodies with k' values >0.6 are generally significantly less soluble. According to Table 13, all the BABPs exhibited excellent solubility.

TABLE 13

Solubility analysis of exemplary CTLA-4 × PD-1 BABPs

| Construct | Concentration (mg/mL) | Monomeric molecule | K' |
|---|---|---|---|
| BCP-73 | 194.4 | 94.1% | 0.07 |
| BCP-74 | 189.2 | 92.7% | 0.04 |
| BCP-75 | 290.9 | 92.6% | 0.03 |
| BCP-78 | 248.0 | 93.4% | 0.06 |
| BCP-79 | 337.5 | 93.5% | 0.04 |
| BCP-80 | 206.1 | 92.8% | 0.03 |

Affinity Determination of Bispecific Antibodies

After purification, the binding affinity parameters of the bispecific antibodies were measured and compared with their monomer antibodies (e.g., anti-CTLA-4 Ab, anti-PD-L1 Ab, or anti-PD-1 Ab), with a similar method as described in Example 1. Yervoy® served as a positive anti-CTLA-4 Ab control, Keytruda® and Opdivo® served as positive anti-PD-1 Ab control, Tecentriq® served as positive control for anti-PD-L1 antibody. Briefly, for determining binding affinity to CTLA-4, antibodies were immobilized onto the chip and the CTLA-4-His protein was flowed as analyte at concentrations of 12.5, 25, 50, 100 and 200 nM; for determining binding affinity to PD-1, antibodies were immobilized onto the chip and the PD-1-His protein was flowed as analyte at concentrations of 3.125, 6.25, 12.5, 25, 50 and 100 nM; for determining binding affinity to PD-L1, antibodies were immobilized onto the chip and the PD-L1-His protein was flowed as analyte at concentrations of 1.56, 3.125, 6.25, 12.5, 25 and 50 nM.

The binding kinetics data of eight exemplary CTLA-4×PD-1 bispecific antibodies (BCP-311K, BCP-K311 (BCP-2), BCP-73, BCP-74, BCP-75, BCP-78, BCP-79, and BCP-80) are shown in FIGS. 12A-12D, FIGS. 13A-13E, FIGS. 24A-24B, and FIGS. 25A-25B. The results indicated that the binding affinities of the constructed CTLA-4×PD-1 bispecific antibodies to PD-1 and CTLA-4 were very close to the anti-PD-1 monoclonal antibody Keytruda® and Opdivo® (FIGS. 12A-12D, FIGS. 25A-25B), and anti-CTLA-4 monoclonal antibody Yervoy® (FIGS. 13A-13E, FIGS. 24A-24B), respectively.

The binding kinetics data of three exemplary CTLA-4×PD-L1 bispecific antibodies (BCP-83, BCP-84, and BCP-85) are shown in FIGS. 24A-24B and FIGS. 26A-26B. The results indicated that the binding affinities of the constructed CTLA-4×PD-L1 bispecific antibodies to PD-L1 and CTLA-4 were very close to the anti-PD-L1 monoclonal antibody Tecentriq® (FIGS. 26A-26B), and anti-CTLA-4 monoclonal antibody Yervoy® (FIGS. 24A-24B), respectively.

Binding kinetics of BCP-2, BCP-16, BCP-17, BCP-31, BCP-32, BCP-33, BCP-34, BCP-35, BCP-36 to PD-1 were determined using a Surface Plasmon Resonance (SPR) biosensor, BIACORE® T200 (GE Healthcare). Different concentrations of the BABP samples were prepared starting at 50 nM with 3-fold serial dilution. Each BABP sample was immobilized on the sensor chip through the Fc capture method. Antigen PD-1-His was used as the analyte. The dissociation ($k_d$) and association ($k_a$) rate constants were obtained using the BIACORE® T200 evaluation software. The apparent equilibrium dissociation constants ($K_D$) were calculated from the ratio of $k_d$ over $k_a$. As shown in Table 14, the BABPs retained comparable binding kinetics to PD-1 as pembrolizumab (e.g., KEYTRUDA®) and nivolumab (e.g., OPDIVO®).

Binding kinetics of A34311 HCAb and BABPs BCP-2, BCP-16, BCP-17, BCP-31, BCP-32, BCP-33, BCP-34, BCP-35, BCP-36 to CTLA-4 were determined using a Surface Plasmon Resonance (SPR) biosensor, BIACORE® T200 (GE Healthcare). Different concentrations of the BABP samples were prepared starting at 200 nM with 3-fold serial dilution. Each BABP sample was immobilized on the sensor chip through the Fc capture method. Antigen CTLA-4-His was used as the analyte. The dissociation ($k_d$) and association ($k_a$) rate constants were obtained using the BIACORE® T200 evaluation software. The apparent equilibrium dissociation constants ($K_D$) were calculated from the ratio of $k_d$ over $k_a$. As shown in Table 14, the binding kinetics demonstrated that these BABPs exhibited comparable binding kinetics to CTLA-4 as their corresponding anti-CTLA-4 sdAb fused to an Fc (see data for A34311 HCAb). Also, these BABPs had comparable binding kinetics to CTLA-4 as ipilimumab (e.g., YERVOY®).

TABLE 14

Binding data of exemplary CTLA-4×PD-1 BABPs

| Construct | PD-1 | | | CTLA-4 | | |
|---|---|---|---|---|---|---|
| | $K_D$ (nM) | $EC_{50}$ (nM) | $IC_{50}$ (nM) | $K_D$ (nM) | $EC_{50}$ (nM) | $IC_{50}$ (nM) |
| BCP-2 | 5.3 | 5.2 | 2.3 | 11.0 | 16.4 | 11.7 |
| BCP-16 | 3.9 | 12.2 | 8.8 | 4.8 | 26.6 | 8.6 |
| BCP-17 | 3.9 | 2.7 | 4.0 | 39.3 | 17.7 | 33.3 |
| BCP-31 | 8.0 | 3.4 | 5.7 | 4.3 | 31.2 | 15.3 |
| BCP-32 | 7.5 | 8.1 | 4.3 | 4.1 | 71.7 | 14.6 |
| BCP-33 | 8.1 | 1.5 | 2.0 | 9.2 | 48.0 | 26.3 |
| BCP-34 | 9.2 | 5.4 | 4.8 | 6.3 | 24.3 | 18.6 |
| BCP-35 | 7.3 | 3.0 | 4.6 | 7.2 | 20.4 | 17.5 |
| BCP-36 | 8.3 | 1.8 | 2.0 | 6.1 | 26.4 | 17.9 |
| pembrolizumab (KEYTRUDA®) | 6.5 | 1.1 | 1.3 | N/A | N/A | N/A |
| nivolumab (OPDIVO®) | 7.3 | 1.1 | 3.1 | N/A | N/A | N/A |
| A34311 HCAb | N/A | N/A | N/A | 15.0 | 2.1 | 3.5 |
| ipilimumab (YERVOY®) | N/A | N/A | N/A | 17.3 | 13.2 | 8.5 |

Binding to CTLA-4, PD-1, or PD-L1 Expressed on Cells Evaluated by FACS Assay

Figures 33A, 33B:
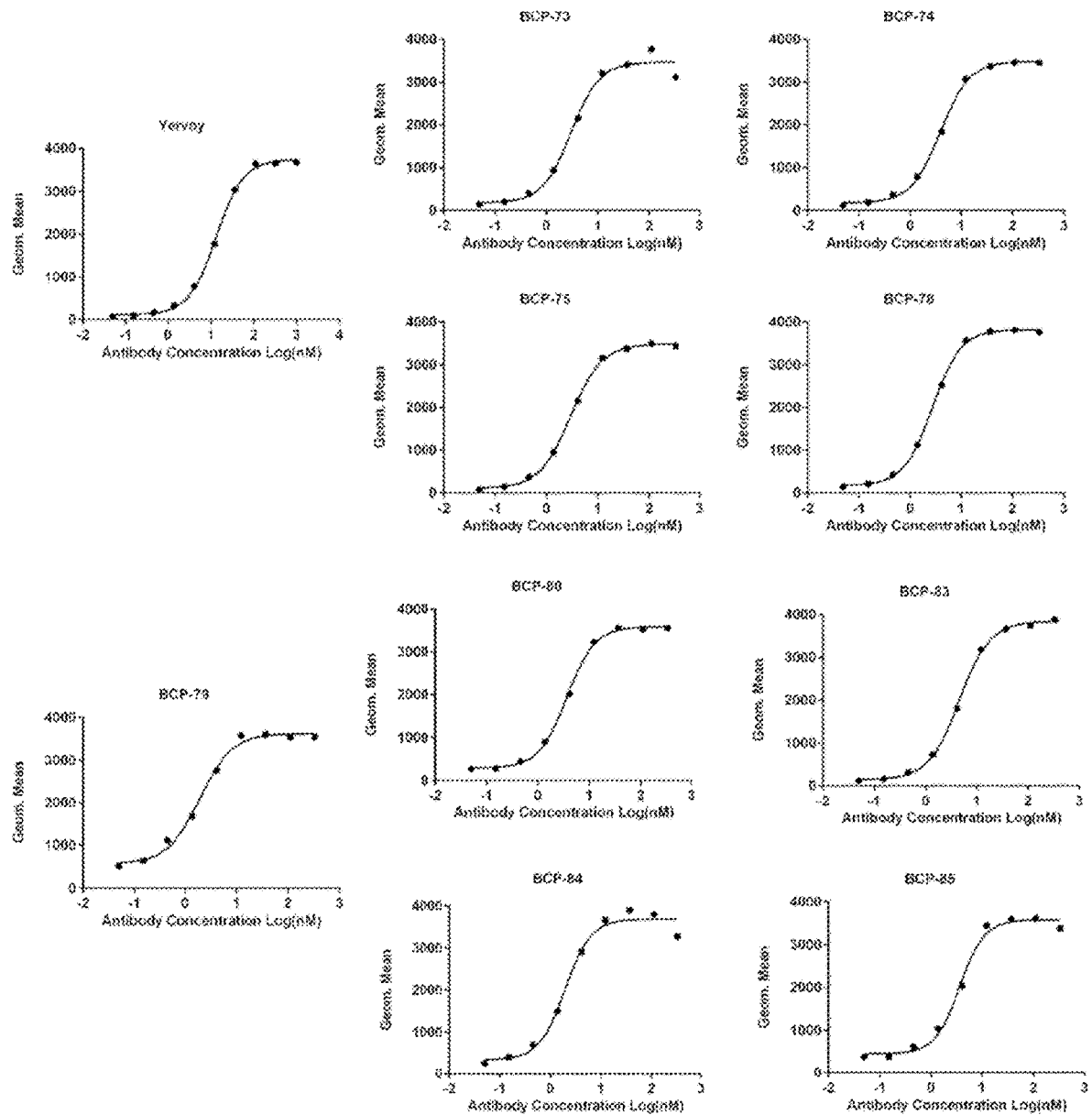
FIGS. 33A-33B depict FACS-based cell binding evaluation of exemplary bispecific CTLA-4×PD-1 or CTLA-4×PD-L1 antibodies to CHO cells expressing human CTLA-4. Yervoy® served as a positive anti-CTLA-4 antibody control. $EC_{50}$ from all assays was summarized in FIG. 33B.

Binding of CTLA-4×PD-1 bispecific antibodies (BCP-73, BCP-74, BCP-75, BCP-78, BCP-79, and BCP-80) or CTLA-4×PD-L1 bispecific antibodies (BCP-83, BCP-84, and BCP-85) to human CTLA-4 expressed on CHO cells was determined using a similar FACS-based assay as described in Example 6 under subsection "CTLA-4-CHO binding by FACS analysis". As shown in FIGS. 33A-33B, the FACS binding assays demonstrated that purified BABPs exhibited comparable CTLA-4 binding ability to Yervoy®.

Figures 34A, 34B:
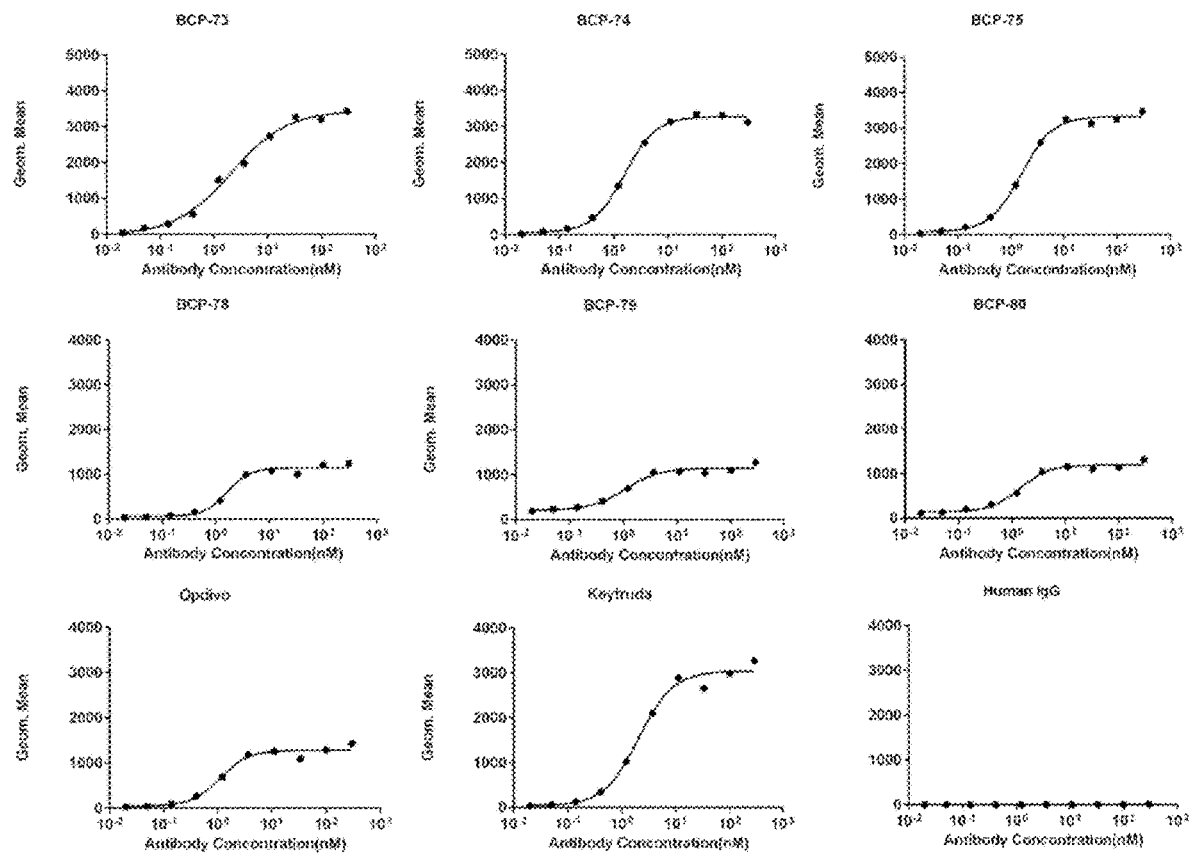
FIGS. 34A-34B depict FACS-based cell binding evaluation of exemplary bispecific CTLA-4×PD-1 antibodies to CHO cells expressing human PD-1. Keytruda® and Opdivo® served as positive anti-PD-1 antibody controls. $EC_{50}$ from all assays was summarized in FIG. 34B.

Binding of CTLA-4×PD-1 bispecific antibodies (BCP-73, BCP-74, BCP-75, BCP-78, BCP-79, and BCP-80) to human PD-1 expressed on CHO cells was determined using a FACS-based assay. CHO cells expressing human PD-1 were dissociated from adherent culture flasks and mixed with varying concentrations of antibodies (both in a 96-well plate). Keytruda® and Opdivo® were used as anti-PD-1 antibody positive controls. Human IgG was used as a negative binding control. The mixture was equilibrated for 30 minutes at room temperature, washed three times with FACS buffer (PBS containing 1% BSA). FITC-conjugated anti-human kappa antibody (Jackson ImmunoResearch) used as secondary antibody was then added and incubated for 15 minutes at room temperature. Cells were washed again with FACS buffer and analyzed by flow cytometry. Data were analyzed with Prism (GraphPad Software, San Diego, Calif.) using non-linear regression, and $EC_{50}$ values were calculated. As shown in FIGS. 34A-34B, the FACS binding assays demonstrated that these CTLA-4×PD-1 bispecific antibodies exhibited comparable PD-1 binding ability to Keytruda® and Opdivo®.

Figures 35A, 35B:
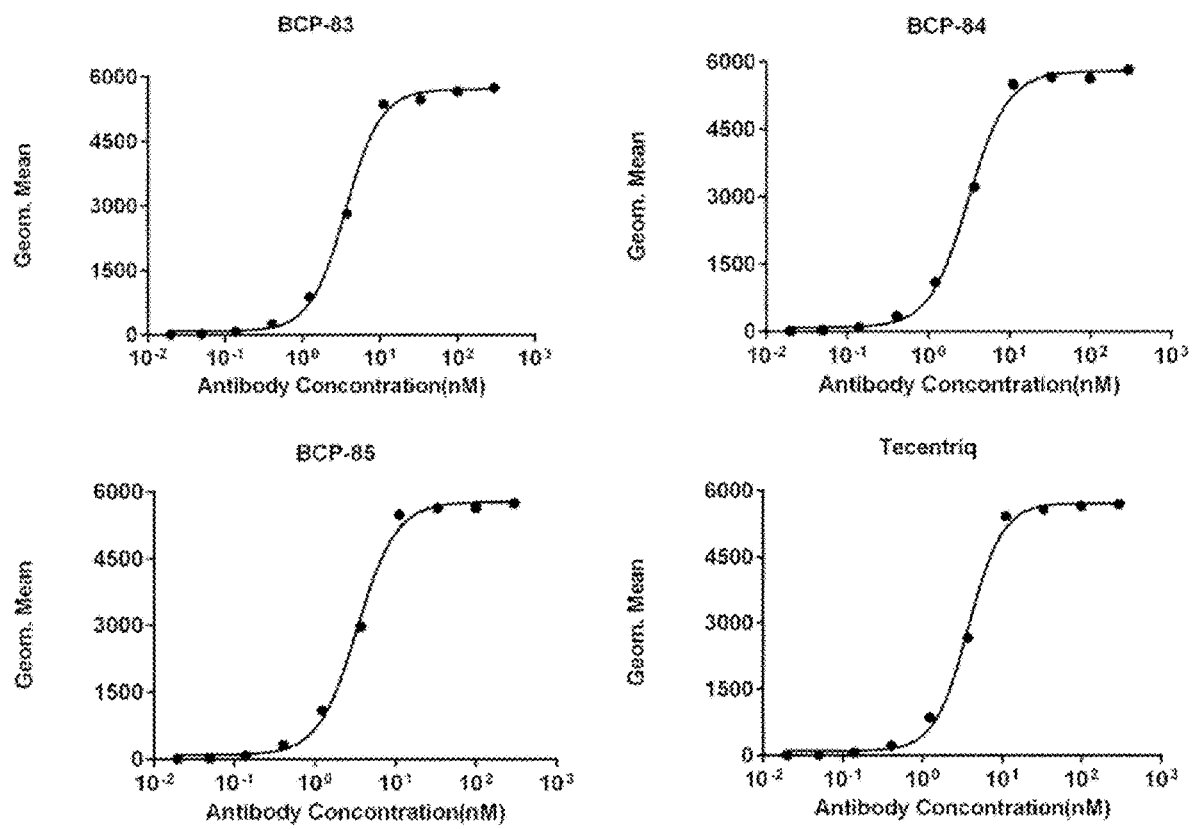
FIGS. 35A-35B depict FACS-based cell binding evaluation of exemplary bispecific CTLA-4×PD-L1 antibodies to CHO cells expressing PD-L1. Tecentriq® served as a positive anti-PD-L1 antibody control. $EC_{50}$ from all assays was summarized in FIG. 35B.

Binding of CTLA-4×PD-L1 bispecific antibodies (BCP-83, BCP-84, and BCP-85) to human PD-L1 expressed on CHO cells were similarly determined. Tecentriq® was used as an anti-PD-L1 antibody positive control. As shown in FIGS. 35A-35B, the FACS binding assays demonstrated that these CTLA-4×PD-L1 bispecific antibodies exhibited comparable PD-L1 binding ability to Tecentriq®.

Binding affinities of BABPs BCP-2, BCP-16, BCP-17, BCP-31, BCP-32, BCP-33, BCP-34, BCP-35, BCP-36 to PD-1 expressed on CHO cells were determined using a similar FACS-based assay as described above. BABP samples were prepared (starting at 1 μM, 3-fold serial dilution with 10 concentrations) as primary antibodies for FACS analysis. As shown in Table 14, the FACS binding assays demonstrated that these BABPs retained comparable PD-1 binding affinities as pembrolizumab (e.g., KEYTRUDA®) and nivolumab (e.g., OPDIVO®).

Binding affinities of BABPs BCP-2, BCP-16, BCP-17, BCP-31, BCP-32, BCP-33, BCP-34, BCP-35, BCP-36 to CTLA-4 expressed on CHO cells were similarly determined. BABP samples were prepared (starting at 1 µM, 3-fold serial dilution with 10 concentrations) as primary antibody for FACS analysis. A34311 HCAb and ipilimumab (e.g., YERVOY®) were used as anti-CTLA-4 antibody positive controls. As show in Table 14, the FACS binding assays demonstrated that these BABPs exhibited comparable binding affinities to CTLA-4 as their corresponding sdAbs fused to an Fc (see data for A34311 HCAb). Also, these BABPs showed comparable binding affinities to CTLA-4 as ipilimumab (e.g., YERVOY®).

Inhibition of Ligand Binding by FACS Analysis

Inhibition of ligand binding by the BABPs was assessed using a FACS assay.

Figure 20J:
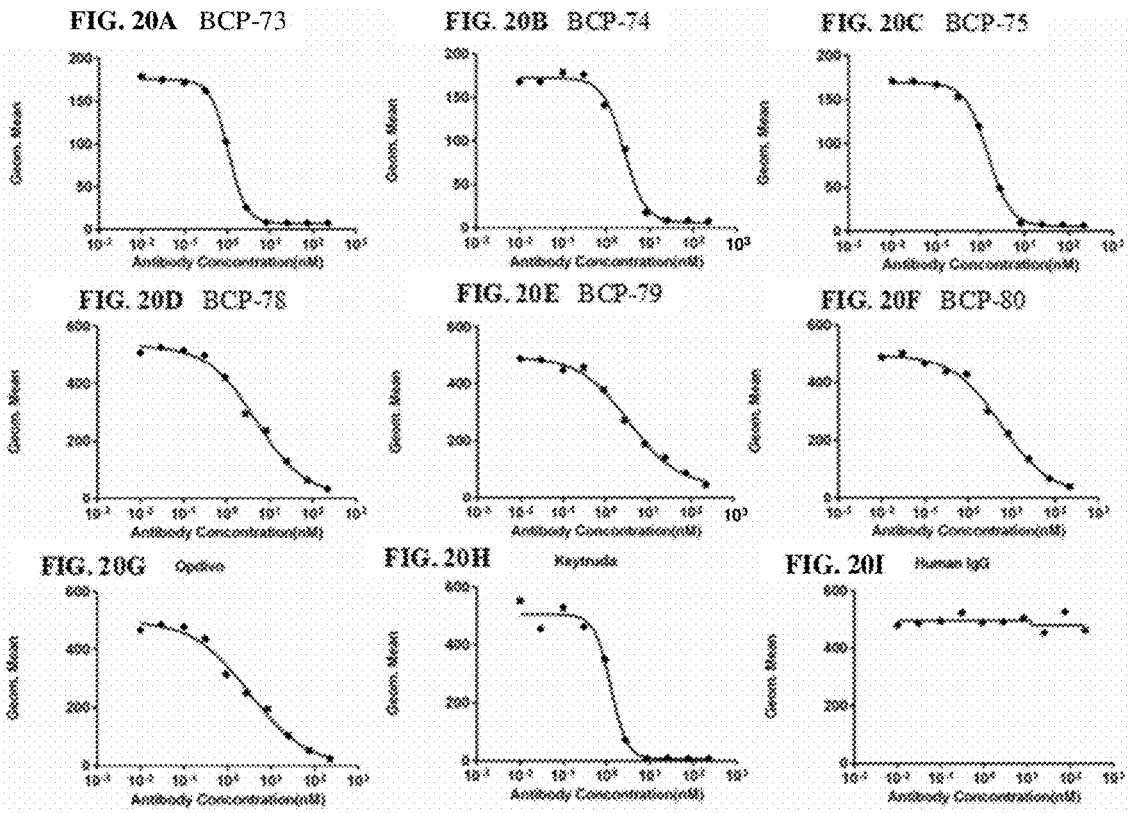

To assess inhibition of PD-1 by BABPs BCP-73, BCP-74, BCP-75, BCP-78, BCP-79, BCP-80, BCP-2, BCP-16, BCP-17, BCP-31, BCP-32, BCP-33, BCP-34, BCP-35, and BCP-36, BABP samples were prepared (starting at 1 µM, 3-fold serial dilution with 10 concentrations). CHO cells expressing human PD-1 were dissociated from adherent culture flasks and mixed with varying concentrations of each BABP and 0.5 µM hPD-L1-Fc fusion protein having a biotin label. Pembrolizumab (e.g., Keytruda®) or nivolumab (e.g., Opdivo®) was used as an anti-PD-1 antibody positive control. The mixture was equilibrated for 30 minutes at room temperature, and washed three times with FACS buffer (PBS containing 1% BSA). PE/Cy5 Streptavidin secondary antibody was then added to the mixtures and incubated for 15 minutes at room temperature. Subsequently, the cells were washed with FACS buffer and analyzed by flow cytometry. Data was analyzed with PRISM™ (GraphPad Software, San Diego, Calif.) using non-linear regression, and $IC_{50}$ values were calculated (Table 14, FIGS. 20A-20J). The competition assays demonstrated the ability of the BABPs to efficiently inhibit PD-1/PD-L1 interactions at low concentrations (1-10 µg/ml). The binding data in Table 14 and FIG. 20J indicate that the functional activities of the exemplary CTLA-4×PD-1 BABPs are very similar to pembrolizumab (e.g., KEYTRUDA®) and nivolumab (e.g., OPDIVO®).

To assess inhibition of B7-1 (a CTLA-4 ligand) by the CTLA-4×PD-1 BABPs BCP-73, BCP-74, BCP-75, BCP-78, BCP-79, BCP-80, BCP-2, BCP-16, BCP-17, BCP-31, BCP-32, BCP-33, BCP-34, BCP-35, BCP-36, and CTLA-4×PD-L1 BABPs BCP-83, BCP-84, BCP-85, BABP samples were prepared (starting at 1 µM, 3-fold serial dilution with 10 concentrations). CHO cells expressing human B7-1 were dissociated from adherent culture flasks and mixed with varying concentrations of each BABP and 0.5 µM hCTLA-4-Fc fusion protein having a biotin-label. A34311 HCAb and ipilimumab (e.g., YERVOY®) were used as anti-CTLA-4 antibody positive controls. The mixture was equilibrated for 30 minutes at room temperature, and washed three times with FACS buffer (PBS containing 1% BSA). PE/Cy5 Streptavidin secondary antibody was then added to the mixtures and incubated for 15 minutes at room temperature. Subsequently, the cells were washed again with FACS buffer and analyzed by flow cytometry. Data were analyzed with PRISM™ (GraphPad Software, San Diego, Calif.) using non-linear regression, and $IC_{50}$ values were calculated (Table 14, FIGS. 19A-19L). The competition assays demonstrated the ability of the BABPs to efficiently inhibit CTLA4-B7-1 interactions at low concentrations (1-10 µg/ml). The binding data in Table 14 and FIG. 19L indicated that the functional activities of the exemplary CTLA-4×PD-1 and CTLA-4×PD-L1 BABPs were similar to their corresponding anti-CTLA-4 sdAb fused to an Fc (see data for A34311 HCAb) and ipilimumab (e.g., YERVOY®).

To assess inhibition of PD-L1 by CTLA-4×PD-L1 BABPs BCP-83, BCP-84, BCP-85, CHO cells expressing human PD-L1 were dissociated from adherent culture flasks and mixed with varying concentrations of each BABP (starting at 1 µM, with 3-fold serial dilution for 10 concentrations) and 0.1 µM of hPD-1-Fc fusion protein having a biotin label. Atezolizumab (e.g., Tecentriq®) was used as a positive antibody control for anti-PD-L1. Human IgG was used as a negative control. Pembrolizumab (e.g. Keytruda®) was used as a control for anti-PD-1 antibody, which would bind to hPD-1-Fc fusion protein and block PD-L1-PD-1 interactions. The mixture was equilibrated for 30 minutes at room temperature, and washed three times with FACS buffer (PBS containing 1% BSA). PE/Cy5 Streptavidin secondary antibody was then added to the mixtures and incubated for 15 minutes at room temperature. Subsequently, the cells were washed with FACS buffer and analyzed by flow cytometry. Data was analyzed with PRISM™ (GraphPad Software, San Diego, Calif.) using non-linear regression, and $IC_{50}$ values were calculated and shown in FIGS. 21A-21G. The competition assays demonstrated the ability of these CTLA-4×PD-L1 BABPs to efficiently inhibit PD-1/PD-L1 interactions similar to atezolizumab (e.g., Tecentriq®) and pembrolizumab (e.g. Keytruda®).

The expression profile and dual-binding properties of the BABPs clearly demonstrated bispecificity of the BABPs, which have a first specificity provided by the antigen binding site formed by correct pairing of the $V_H$ and $V_L$, of the 4-chain antibody (2-chain for BCP-34), and the second specificity provided by the $V_H$Hs.

In Vitro Functional Assays

Blockade of PD-1 and CTLA-4 pathways by BABPs CTLA-4×PD-1 or blockade of PD-L1 and CTLA-4 pathways by BABPs CTLA-4×PD-L1 can be studied using a variety of bioassays that monitor T cell proliferation, IFN-γ release, IL-2 secretion, or expression of reporter genes driven by signaling molecules in the PD-1, PD-L1, or CTLA-4 pathway.

For example, PD-1 inhibition by CTLA-4×PD-1 bispecific antibodies can be studied by determining the IL-2 secretion level in mixed lymphocyte reactions (MLR) comprising target cells expressing PD-L1 and activated T cells (expressing PD-1, CTLA-4 on surface), with CTLA-4×PD-1 bispecific antibodies provided at various concentrations.

Human CD4+ T cells and allogeneic monocytes were purified from PBMC using the isolation kits (Miltenyl Biotec). Monocytes were induced into dendritic cells. Each well contained $10^5$ CD4$^+$ T cells and $10^4$ allogeneic dendritic cells with a final working volume of 200 µl. CTLA-4×PD-1 BABPs (BCP-73, BCP-74, BCP-75, BCP-78, BCP-79, BCP-80) or CTLA-4×PD-L1 BABPs (BCP-83, BCP-84, BCP-85) were added into each well at different concentrations. No antibody was used as a background control. Human IgG4 was used as a negative control. Yervoy® was used as the positive anti-CTLA-4 antibody control. After 72-hour incubation in 37° C./5% $CO_2$ incubator, 100 µl medium was taken from each testing well for IL-2 secretion measurement (Cisbio). Antibody concentration-dependent secretion of IL-2 in the MLRs was used to extract an $EC_{50}$ value for anti-CTLA-4 activity (FIG. 29B) of CTLA-4× PD-1 BABPs or CTLA-4×PD-L1 BABPs, and compared with the $EC_{50}$ value of Yervoy®. Consistent with the FACS-based ligand competition assay results (see FIG. 19L), the functional activities of CTLA-4×PD-1 BABPs or CTLA-4×

Figures 29A, 29B:
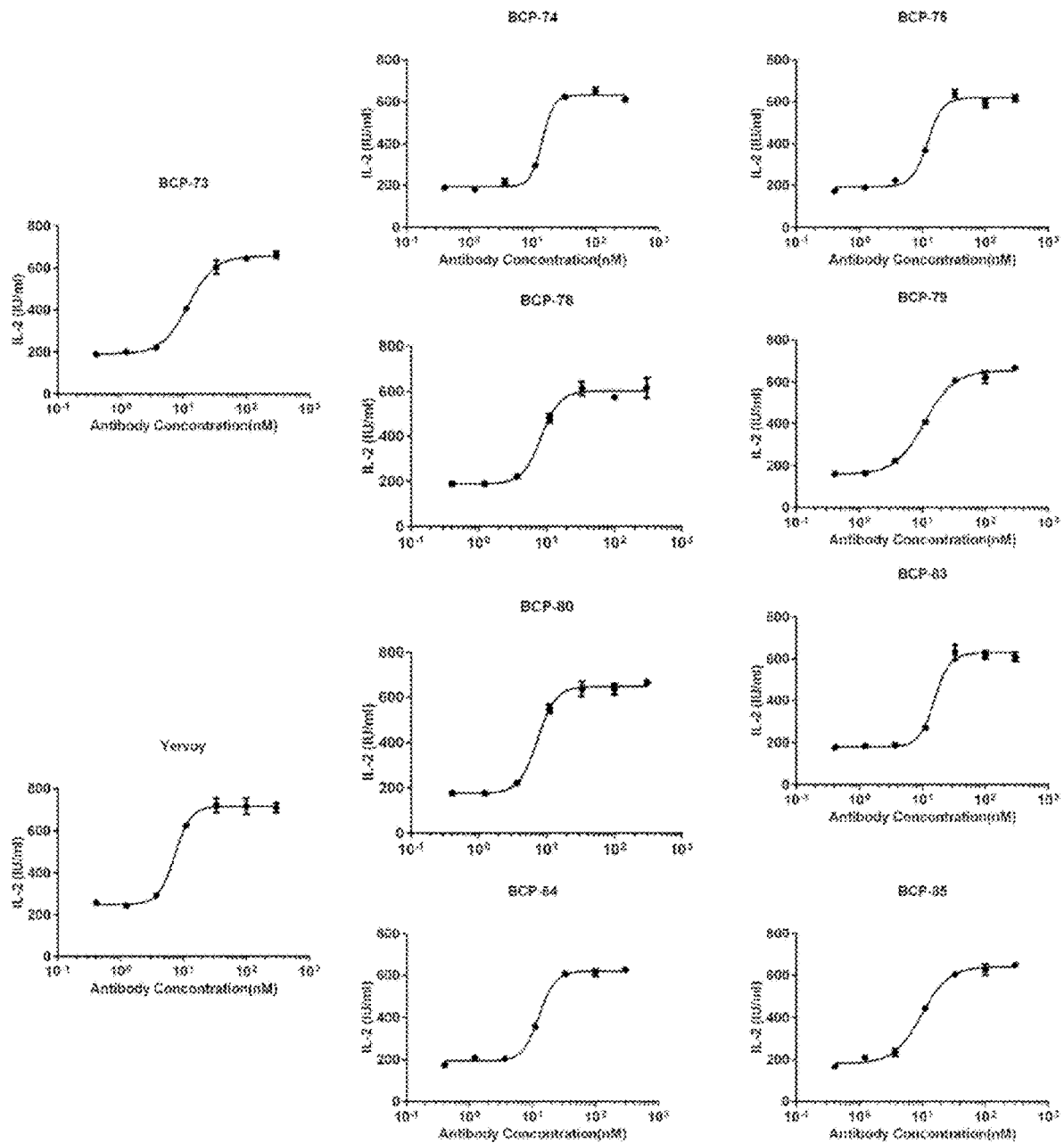
FIGS. 29A-29B depict functional activity evaluation of exemplary bispecific CTLA-4×PD-1 or CTLA-4×PD-L1 antibodies by CTLA-4-based blockade assay. Yervoy® served as a positive anti-CTLA-4 antibody control (FIG. 29A). $EC_{50}$ from all assays was summarized in FIG. 29B.

PD-L1 BABPs in binding to CTLA-4 were comparable to their monoclonal antibody Yervoy® (FIGS. 29A-29B).

Figures 30A, 30B:
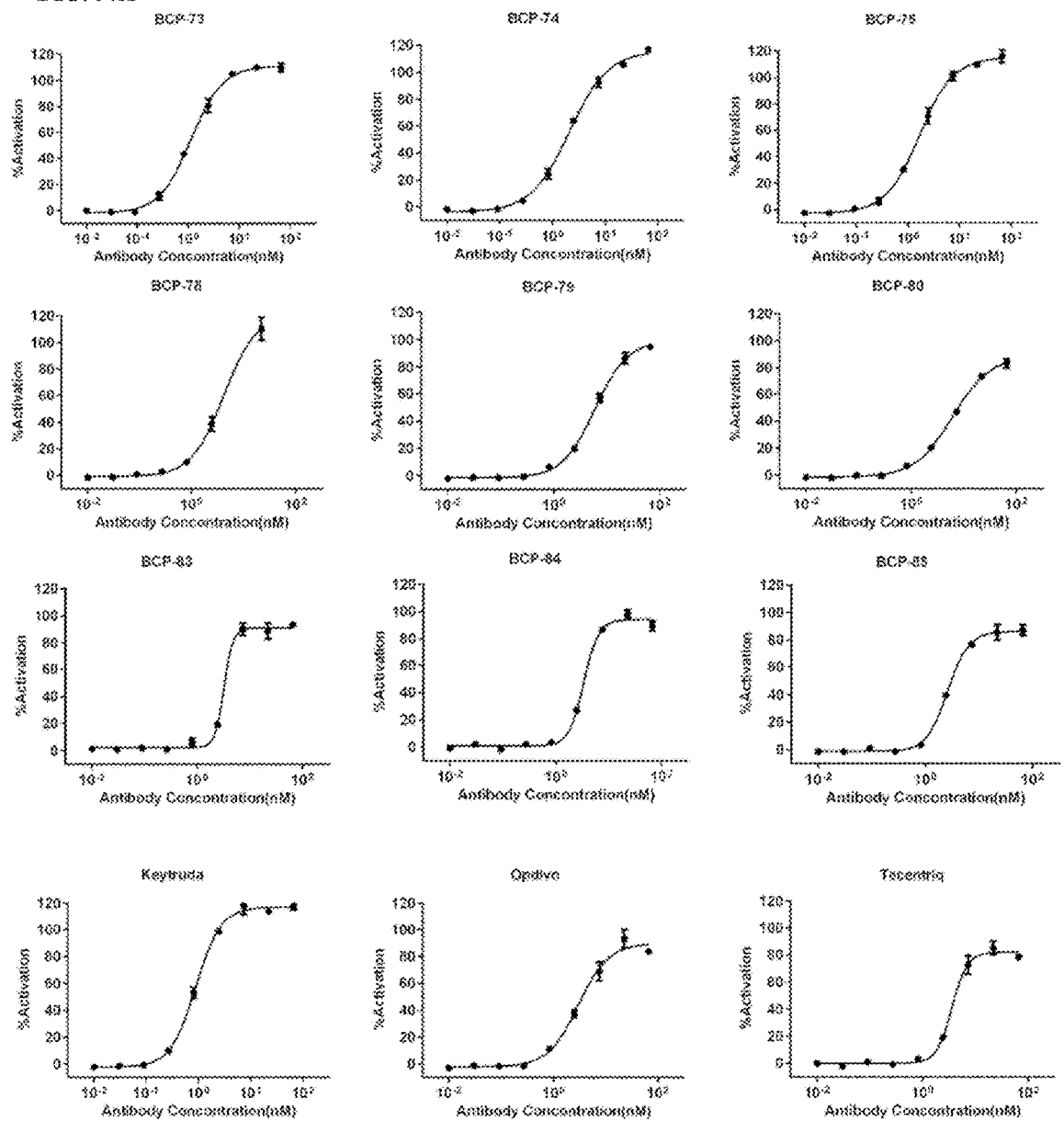
FIGS. 30A-30B depict functional activity evaluation of exemplary bispecific CTLA-4×PD-1 or CTLA-4×PD-L1 antibodies by PD-1/PD-L1-based blockade assay. Keytruda® and Opdivo® served as positive anti-PD-1 antibody controls. Tecentriq® served as a positive anti-PD-L1 antibody control (FIG. 30A). $EC_{50}$ from all assays was summarized in FIG. 30B.

Characterization of biological activity of CTLA-4×PD-1 and CTLA-4×PD-L1 BABPs in PD-1/PD-L1 cell-based assay using the PD-1/NFAT Reporter-Jurkat T cells (recombinant Jurkat T cell expressing firefly luciferase gene under the control of NFAT response elements with constitutive expression of human PD-1) is shown in FIGS. 30A-30B. In this case, CHO-K1 cells were stably expressed with human PD-L1 and an engineered T cell receptor (TCR) activator. The effecter cell PD-1/NFAT Reporter-Jurkat T cells were pre-incubated with serial dilution of CTLA-4×PD-1 BABPs for 30 minutes prior to co-culture with engineered CHO-K1 cells; or, engineered CHO-K1 cells were pre-incubated with serial dilution of CTLA-4×PD-L1 BABPs for 30 minutes prior to co-culture with effecter cell PD-1/NFAT Reporter-Jurkat T cells. After ~6 hours of stimulation, ONE-STEP™ Luciferase reagent was added to the cells to measure NFAT activity. Data was analyzed with PRISM™ (GraphPad Software, San Diego, Calif.) using non-linear regression, and $EC_{50}$ values were calculated (FIG. 30B). The reporter assay demonstrated the ability of all CTLA-4×PD-1 BABPs (BCP-73, BCP-74, BCP-75, BCP-78, BCP-79, BCP-80) to efficiently block PD-1/PD-L1 signaling and allow NFAT signal activation, similarly as their monospecific parental antibody KEYTRUDA® or OPDIVO®; and that all CTLA-4×PD-L1 BABPs (BCP-83, BCP-84, BCP-85) efficiently blocked PD-1/PD-L1 signaling for NFAT signal activation, similarly as their monospecific parental antibody Tecentriq®.

Example 9: In Vivo Efficacy Study of Bispecific Antibodies

Figure 37A:
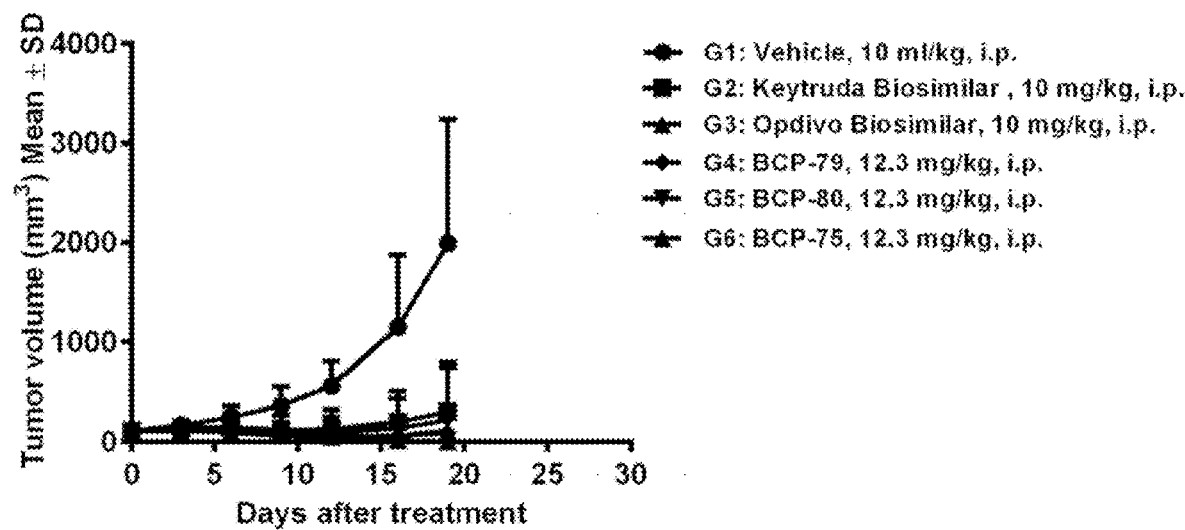
FIGS. 37A-37B depict in vivo efficacy study of exemplary CTLA-4×PD-1 bispecific antibodies BCP-75, BCP-79, and BCP-80 using MC38 syngeneic mouse model in PD-1 KI mice.
Figure 37B:
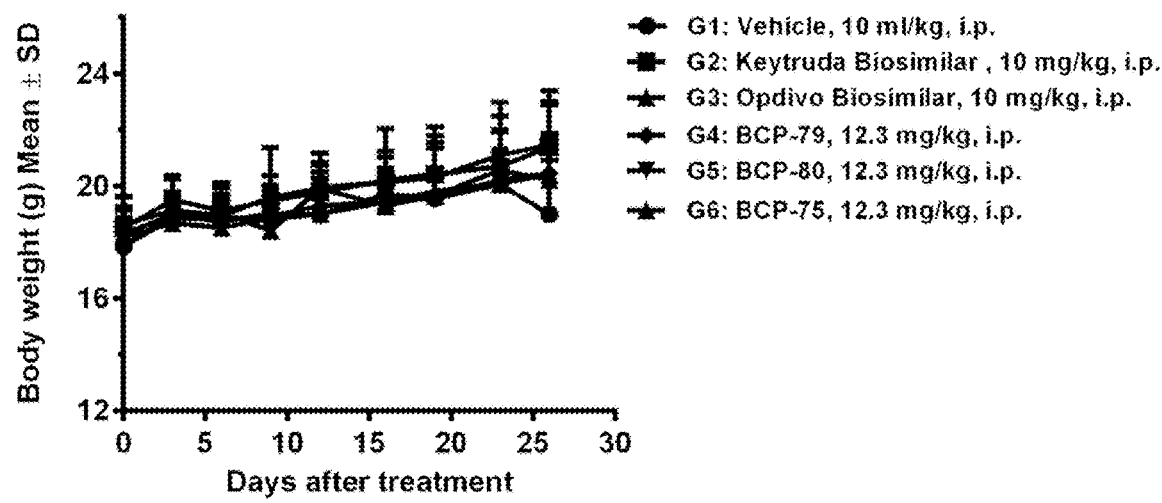

Effects of exemplary CTLA-4×PD-1 bispecific antibodies to PD-1 on tumor growth were compared to those of anti-PD-1 antibody (in-house generated Opdivo biosimilar and Keytruda biosimilar 4-chain antibodies). 6-8-week-old human PD-1 KI (knock-in) female C57/BL6 mice were shaved on their lower dorsum and s.c. injected with $1\times10^6$ colon cancer cell line MC38 in a 50 µL suspension of 75% (vol/vol) RPMI (Life Technologies) and 25% (vol/vol) medium-density matrigel (Corning). Mice whose tumors failed to engraft within 7 days by visual inspection were excluded from further study. Tumors were measured on a daily basis starting at day 7 after MC38 engraftment. Mice were individually sorted into treatment cohorts, and started to receive treatment only when tumors reached a threshold of 150 mm$^3$, about 10 days post engraftment in all cases. Digital caliper measurements and bodyweight measurements were taken every three days for the duration of treatment (FIGS. 37A-37B). In the experiments, mice were given treatment intraperitoneally (i.p.) for 16 days with 10 mg/kg Keytruda biosimilar antibody (pembrolizumab) or Opdivo biosimilar antibody (nivolumab), or 12.3 mg/kg of CTLA-4×PD-1 bispecific antibodies (BCP-75, BCP-79, and BCP-80). The treatment was conducted every 4 days. Mice injected with PBS served as negative control. As can be seen from FIG. 37A, all bispecific antibodies effectively controlled tumor growth in the MC38 syngeneic mice model, with a comparable functional activity to Keytruda biosimilar and Opdivo biosimilar. All treatments did not affect the body weights of MC38 engrafted mice, as compared to the mock control (FIG. 37B).

Figure 38A:
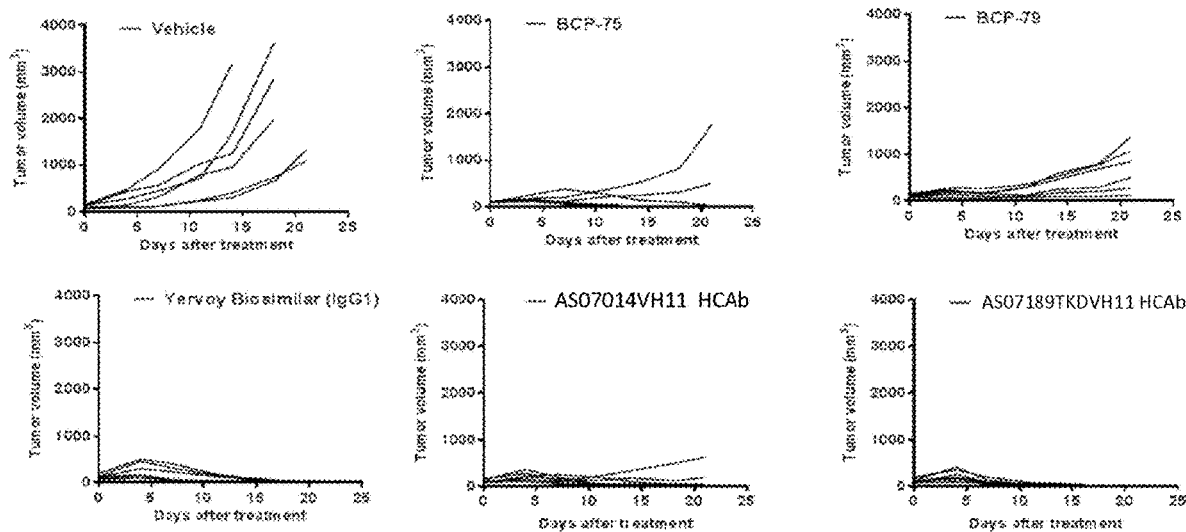
FIGS. 38A-38B depict in vivo efficacy study of exemplary CTLA-4×PD-1 bispecific antibodies BCP-75, BCP-79, and BCP-80 using MC38 syngeneic mouse model in CTLA-4 KI mice.
Figure 38B:
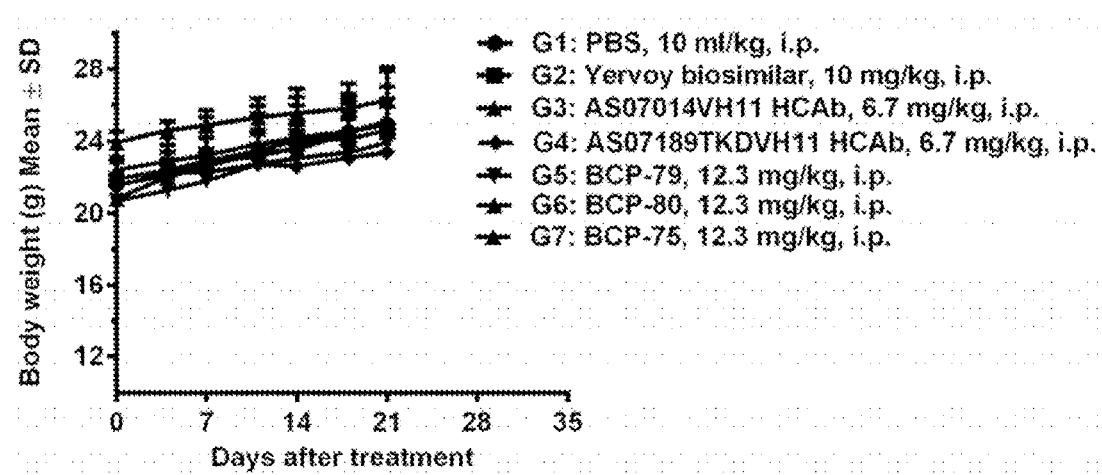

Effects of exemplary CTLA-4×PD-1 bispecific antibodies to CTLA-4 on tumor growth were compared to those of an anti-CTLA-4 antibody (Yervoy biosimilar). 6-8-week-old human CTLA-4 KI (knock-in) female C57/BL6 mice were shaved on their lower dorsum and s.c. injected with $1\times10^6$ colon cancer cell line MC38 in a 50 µL suspension of 75% (vol/vol) RPMI (Life Technologies) and 25% (vol/vol) medium-density matrigel (Corning). Mice whose tumors failed to engraft within 7 days by visual inspection were excluded from further study. Tumors were measured on a daily basis starting at day 7 after MC38 engraftment. Mice were individually sorted into treatment cohorts, and started to receive treatment only when tumors reached a threshold of 150 mm$^3$, about 10 days post engraftment in all cases. Digital caliper measurements and bodyweight measurements were taken every three days for the duration of treatment (FIGS. 38A-38B). In the experiments, mice were given treatment intraperitoneally (i.p.) for 16 days with 10 mg/kg Yervoy biosimilar antibody, 12.3 mg/kg CTLA-4×PD-1 bispecific antibodies (BCP-75, BCP-79, or BCP-80), or 6.7 mg/kg of their corresponding anti-CTLA-4 HCAbs (AS07014VH11 HCAb or AS07189TKDVH11 HCAb). Mice injected with PBS served as mock control. The treatment was conducted every 4 days. As can be seen from FIG. 38A, all CTLA-4×PD-1 bispecific antibodies effectively controlled tumor growth in the MC38 syngeneic mice model, with a comparable functional activity to Yervoy biosimilar. All treatments did not affect the body weights of MC38 engrafted mice, as compared to the mock control (FIG. 38B).

Figure 39A:
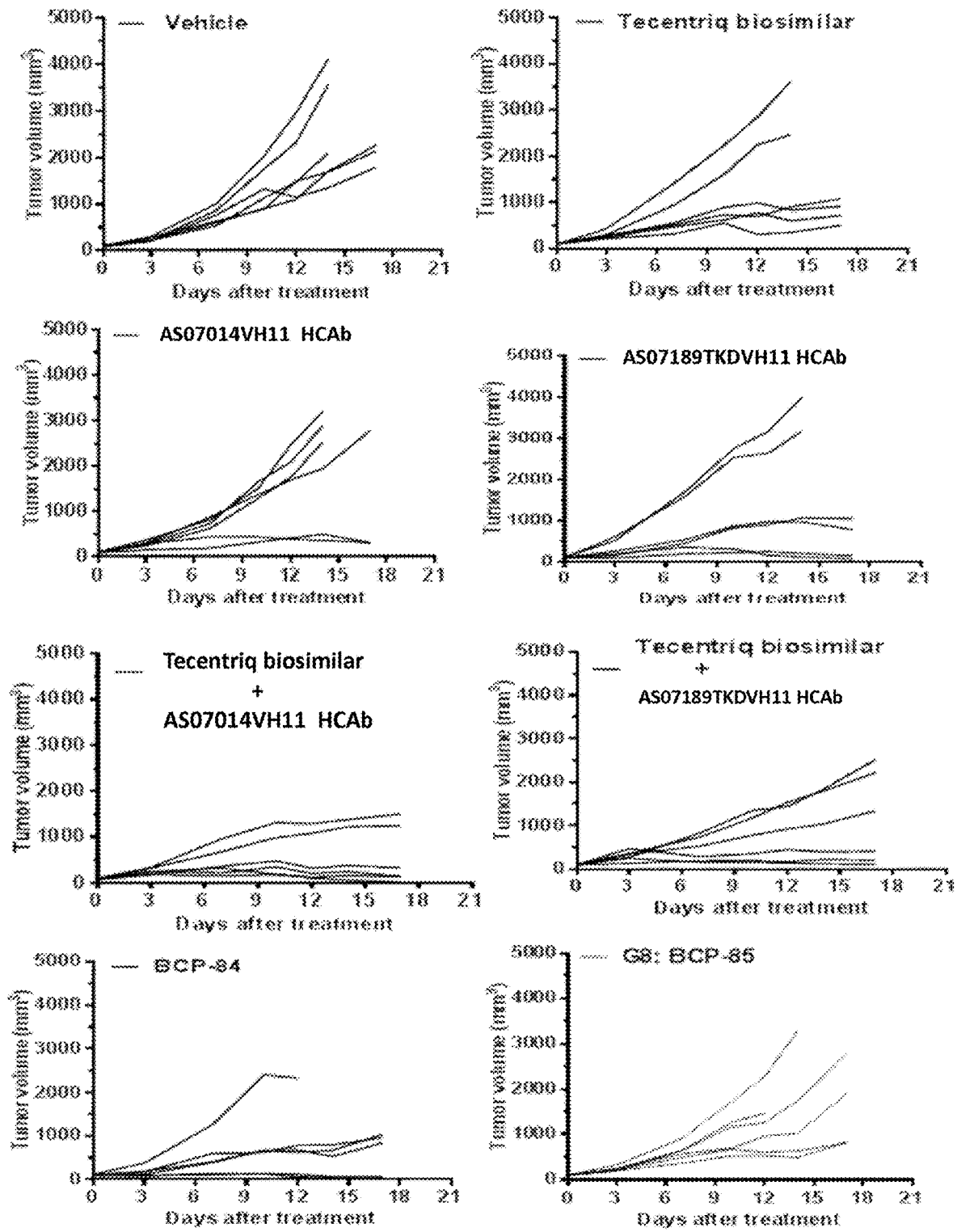
FIGS. 39A-39B depict in vivo efficacy study of exemplary CTLA-4×PD-L1 bispecific antibodies BCP-84 and BCP-85 using human PD-L1 KI MC38 syngeneic mouse model in CTLA-4 KI mice. An in-house expressed Tecentriq biosimilar 4-chain antibody served as positive control for anti-PD-L1.
Figure 39B:
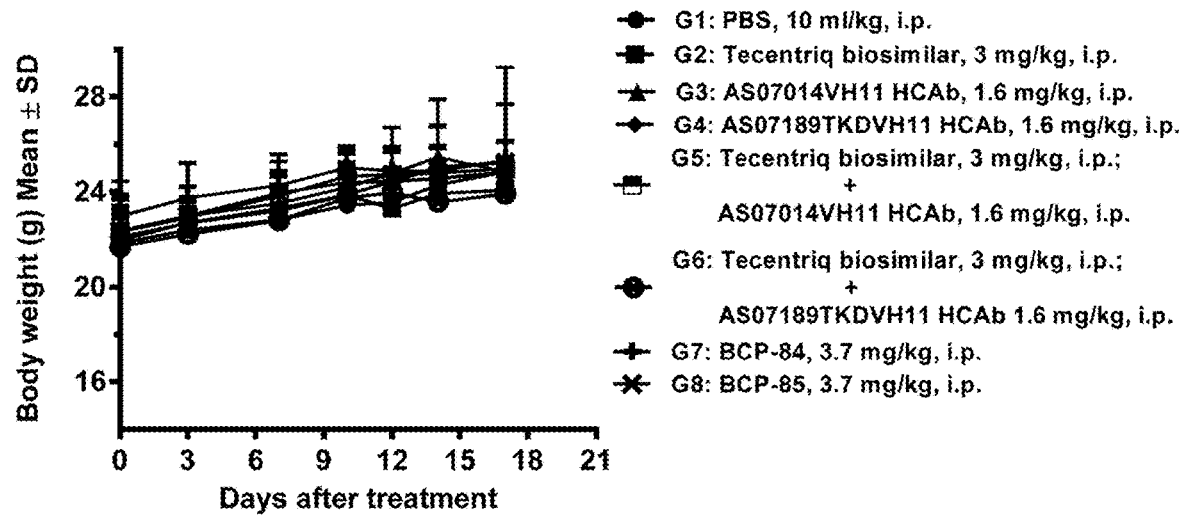

Effects of exemplary CTLA-4×PD-L1 bispecific antibodies (BCP-84, BCP-85) to CTLA-4 and PD-L1 on tumor growth were tested on a mouse xenograft model prepared by implanting PD-L1 expressing tumor cells into C57BL/6 CTLA-4 KI mice. A murine colon adenocarcinoma cell line MC38 stably expressing human PD-L1 was used in this assay. 8-week-old C57BL/6 CTLA-4 KI mice were shaved on their lower dorsum and s.c. injected with $1\times10^7$ MC38-hPD-L1 KI cells. Mice whose tumors failed to engraft within 7 days by visual inspection were excluded from further study. Tumors were measured on a daily basis starting at day 7 after MC38 engraftment. Tumor size was measured with a caliper, and tumor volume was calculated by the modified ellipsoid formula: length×(width)/2. When tumors reached a volume of approximately 90-130 mm$^3$, mice were randomly assigned to different treatment groups, which were maintained for 2 or 6 weeks. Digital caliper measurements and bodyweight measurements were taken every three days for the duration of treatment (FIGS. 39A-39B). Mice were given treatment intraperitoneally (i.p.) for 16 days with 3 mg/kg in-house expressed Tecentriq biosimilar antibody, comparable amount (3.7 mg/kg) of CTLA-4×PD-L1 bispecific antibodies (BCP-84 or BCP-85), comparable amount (1.6 mg/kg) of corresponding anti-CTLA-4 HCAbs (AS07014VH11 HCAb or AS07189VH11 HCAb), or combination therapy (Tecentriq biosimilar plus AS07014VH11 HCAb, or Tecentriq biosimilar plus AS07189TKDVH11 HCAb). Mice injected with PBS served as negative control. The treatment was conducted every 4 days. As can be seen from FIG. 39A, all CTLA-4×PD-L1 bispecific antibody groups and the combination therapy groups demonstrated higher tumor inhibition efficacy over either monotherapy (corresponding anti-CTLA-4 HCAbs, or Tecentriq biosimilar) in the mouse tumor model (FIG. 39A). Notably, the anti-tumor efficacy of BCP-84 and BCP-85 was comparable to the combination therapy. All treatments did not affect the body weights of MC38 engrafted mice, as compared to the mock control (FIG. 39B).

SEQUENCE LISTING

SEQ ID NO: 97 (A34310 sdAb nucleic acid sequence)
CAGGTACAGCTGGTGGAGTCTGGGGGAGGCTTGGTGCAGGCTGGGGGGTCTCTGAGACTCTCCTGTGC
AGCCTCTGGATTCACTTTCGATGATTATGCCATAGGCTGGTTCCGCCAGGCCCCAGGGAAGGAGCGTC
AGGGGGTCTCATGTATTAGTAGTGGTGGCACATACTATGCAGATCCGTGAAGGGCCGATTCACCATC
TCCAGTGACAACGCCAAGAACACGGTGTTTCTGCAAATGAACAGCCTGAAACCTGAGGACACGGCTGT
TTATTACTGTGGAGCAGTTTCGTCGCTCTTAAGTGTGGAGAGGTTCCCTGGAGGTCATTGCGGCCCCCG
TTATGGGTACTACCGTCACGGCTACTGGGGCCAGGGGACCCAGGTCACCGTCTCCTCA SEQ ID NO: 98 (A34311 sdAb nucleic acid sequence)
CAGGTAAAGCTGGAGGAGTCTGGGGGAGGCTTGGTGCTGCCTGGGGAGTCTCTGAGACTCTCCTGTGA
AGCCTCTGGTCGCACCATCACAACGATTACTATGGGCTGGTTCCGCCAGGCTCCAGGGAAGGAGCGTC
AGTTTGTAGCGTCTCATAGTTGGACTGATAATAACCCATACTATGCAGACTCCGTTAAGGGCCGATTCA
TCATCTCCAGAGACAACGCCGGGAACAGGGTATATCTGCAGATGCATAGCCTGGAACCTGAGGACAC
GGCCGTTTATTACTGCGCAGCAACCGCTAGAAGATCATTCGTGGGTAGACAGTGGTACACTGAAGCAC
GCCAGTATGACTACTGGGGCCAGGGGACCCAGGTCACCGTCTCCTCA SEQ ID NO: 99 (A34313 sdAb nucleic acid sequence)
CAGGTACAGCTGGTGGAGTCTGGGGGAGGATTGGTGCAGGCTGGGGCTCTCTGAGACTCTCCTGTGC
AACCTCTGTACGCACCCCCCTCAGTAACTTTGCCATGGGCTGGTTCCGCCAGACTCCAGGGAAAGAGC
GTGAGTTTGTAGCAGCAATTAGCAGGAGTGGTGGAAGCACATCGTATGCAGACTCCGTGAAGGGCCG
ATTCACCATCTCCAGGGACAACGCCAAGAACACGGTGTATCTCGAAATGAACAGCCTGAAAGGCGAG
GACACGGTCGTTTATTACTGTGCAGCCAAAATAGCGGGGATGAATAATATTGTCTTTATCGGCGCGCC
CCAGTATAACTACTGGGGCCAGGGGACCCAGGTCACCGTCTCCTCA SEQ ID NO: 100 (A34625 sdAb nucleic acid sequence)
CAGGTAAAGCTGGAGGAGTCTGGGGGAGGCTTGGTGCAGCCTGGGGGGTCTCTGAGACTCTCCTGTGT
AGCGTCTGGAAGCATCGACAGCACCTATACCATGGGCTGGTACCGCCAGGCTCCAGGGAAACAGCGC
GAGTTGGTCGCTTCTATTACTAGTTCTGGTAGCACAAACCATGCAGACTCCGTGAAGGGCCGATTCAC
AATCTCCAGAGACAACGCCAAGAACACGGTGTATCTTCAAATGAACACCCTGAAACCGAGGACGCG
GCCGTCTATTACTGTAGATACCTAAGTGTGCTTAGTGCCTACTGGGGCCAGGGGACCCAGGTCACCGT
CTCCTCA SEQ ID NO: 101 (A36566 sdAb nucleic acid sequence)
GAGGTGCAGCTGGTGGAGTCTGGGGGAGGATTGGTGCAGGTTGGGGACTCTCTGAGACTCTCCTGTGC
AGCCTCTGGACGCTCGTTCGAGAACTATGCCATAGGCTGGTTCCGCCAGGCTCCAGGCAAGGAGCGTG
AGTTTGTAGCAACAATTTCGTGGATTCCTCGTACCGCATACTCTACCACATACTATGCAGACTCCGTGA
AGGGCAGATTCACCATCTCTGGAGACAACAGCAAGAACACGGTATCTGCAAATGACGAGCCTGAA
ACCTGAGGACACGGCCGTTTATTACTGTGCAGCAGGCGGGGCGACAGGACCGTTGGCGTTGGACTCCC
ACTATGGGTACTGGGGCCAGGGGACCCAGGTCACCGTCTCCTCA SEQ ID NO: 102 (A36922 sdAb nucleic acid sequence)
CAGGTACAGCTGGTGGAGTCTGGGGGAGGCTTGGTGCAGGCTGGGGGGTCGCTGAGACTCTCCTGTGC
AGCCTCTGGTCGCCTCAGTAGGACGTTTACCATGGGCTGGTACCGCCAGGCTCCAGGGAAGCAGCGCG
ACTTGGTCGCGTCTATTACTACAAGTGGTAGCACGAACTATGCAGACTCCGTGAAGGGCCGATTCACC
ATCTCCAGAGACAACGCCAAAAACACGGTGATTCTGCAAATGAACAGCCTGGTACCTGAGGACACAG
CCGTCTATTACTGCCGTTTTCTTAGCGCAAGTACTGCAGCCTGGGCCAGGGGACCCAGGTCACCATCT
CCACG SEQ ID NO: 103 (A37067 sdAb nucleic acid sequence)
GCCGTGCAGCTGGTGGATTCTGGGGGAGGCTTGGTGCAGGCTGGGGGGTCGCTGAGACTCTCCTGTGC
AGCCTCTGGAAGCATCAGCAGTCTCAACGCCATGGCATGGTACCGCCAGGGTCCAGGGAAGGAGCGC
GAGCTGGTCGCAAGTATTACTAGGGGTGGTAGTACAGCCTATACAGACTCCGTGAAGGGCCGATTCAC
CATCTCCAGAGACAACGCCAAGAACACGGTGTATCTGCAAATGAACAGCCTGAAACCTGAGGACACA
GCCGTCTATTACTGTAGAGCGGTTTGGGGTTTTGGGGATTATGGTTCCTGGGGCCAGGGGACCCAGGT
CACCGTCTCTTCG SEQ ID NO: 104 (AS07014 sdAb nucleic acid sequence)
CAGGTGCACCTGGTGGAGTCTGGGGGAGGCTCGGTGCAGGCTGGAGGGTCTCTGAGACTCTCCTGTGC
AGCCTCTGGATACACCTACAGTAGACACTGCCTGGGCTGGTTCCGCCAGACTCCAGGGAAGGAGCGCG
AGGCGGTCGCGACTATTGATAGTGATGGTAGCACAAGCTACGCAGACTCCGTGAAGGGCCGATTCACC
ATCTCCAGTGACAACGCCAAGAACACTCTATATCTGCAAATGAACAGCCTGAAACCTGAGGACACTGC
CATGTACTACTGTGCGATAGGGCCGAACCCGCGATATTGTGCTGGCGCCCAACACTCGGGGCGCCG
AACACTACTTTGGTTACTGGGCCCAGGGGACCCAGGTCACCGTCTCCTCA SEQ ID NO: 105 (AS07172 sdAb nucleic acid sequence)
CAGGTGAAGTTAGTGGAGTCTGGGGGAGGCTCGGTGCAGGCTGGAGGGTCTCTAAGACTTTCCTGTGC
AGTGTCTGGAGACGATTTGAGTAACTACTGCATGGGCTGGGTCCGCCAGGCTCCAGGGAAGGAGCGC
GAAGAGGTCGCAACTATTGATTATGCCTTTAAGACAAATTACGCAGACTCCGTGAAGGGCCGGTTCAC
CATCTCCAAAGACAACGCCGAGAATAGTCTACGCGTAAATTTGGAAATGAACGACCTGAAACCTGAC
GACACTGCCATGTACTATTGTGCGGCAGATTGGAGTAGTGGTGGTGTGTGTTTTGGATTAGCGGACTTT
GGTACCCGGGGCCAGGGGACCCAGGTCACCGTCTCCTCA SEQ ID NO: 106 (AS07189 sdAb nucleic acid sequence)
CAGGTGCAGCTGGTGGAGTCTGGGGGAGGCTCGGTGCAGGCTGGAGGGTCTCTGAGACTCTCCTGTGC
AGCCTCTGGAGACAGTCCTAGTGTGAACTACATGGGCTGGTTCCGCCGGGCTCCAGAAAACAGCGCG
AGCAGCGCGAGGAGGTCGCAAGTATTTATCCCACAGGTGGCACGTTTTACACAGACTCCGTGAAGGGC
CGATTCACCATCTCCCGAGACAACGCCAAGAACACTCTGTATCTCCAAATGACCGCCCTGAAACCTGA
GGATACTGCCATGTACTACTGTGCGGCAGGAAAATGGGGGACTGACTACTGGGGCCAGGGGACCCAG
GTCATCGTCTCCTCA

SEQUENCE LISTING

SEQ ID NO: 107 (AS07392 sdAb nucleic acid sequence)
CAGGTGAAGTTGGTGGAGTCTGGGGGAGGCTCGGTGCAGGCTGGAGGGTCTCTGAGACTCTCCTGTGC
AGCCTCTGGAGACAGTTATAGTGTGAAGTACATGGGCTGGTTCCGCCGGGCTCCAGGGAAACAGCGCG
ACCAGCGCGAGGAGGTCGCAAGTATTTATCCCACAGGTGGCACGTTTTACACAGACTCCGTGAAGGGC
CGATTCACCATCTCCCGAGACAACGCCAAGAGCACTCTGTATCTCCAAATGACCGCCCTGAAACCTGA
GGATACTGCCATGTACTACTGTGCGGCAGGCAAATGGGGGACTGACTACTGGGGCCAGGGGACCCAG
GTCACCGTCTCCTCA SEQ ID NO: 108 (AS07678 sdAb nucleic acid sequence)
CAGGTGCACCTGATGGAGTCTGGGGGAGGCTCGGTGCAGGCTGGAGGGTCTCTGAGACTCTCCTGTGC
AGCCTCTGGATACACCTACAGTAGGTACTGCCTGGGCTGGTTCCGCCAGACTCCAGGGAAGGAGCGCG
AGGCGGTCGCAACTATTGATATTGATGGTAGCACAAGCTACGCAGATCCGTGAAGGGCCGATTCACC
ATCTCCAATGACAACGCCAAGAACACTCTATATCTGCAAATGAACATCCTGAAACCTGAGGACACTGC
CATGTACTACTGTGCGGCAGGGCCGAACCCGCGATATTGTAGTGGCGCAGTCTACACTCGGGGCGCCG
AACACTACTTTGGTTACTGGGGCCAGGGGACCCAGGTCACCGTCTCCTCA SEQ ID NO: 109 (AS07688 sdAb nucleic acid sequence)
CAGATTCAGCTGGTGGAGTCTGGGGGAGGCTCGGTGCAGGCTGGAGGGTCTCTGAGACTCTCCTGTGC
AGCCTCTGGAGACAGTTATAGTGTGAACTACATGGGCTGTTCCGCCGGGCTCCAGGGCAACAGCGCG
AGCAGCGCGAGGAGGTCGCAAGTATTTATGCCACGGGTGGCACGTTTTACAGAGACTCCGTGAAGGG
CCGATTCACCATCTCCCGAGACAACGCCAAGAACACTCTGTATCTCCAAATGACCGCCCTGAAACCTG
AGGATACTGCCATGTACTACTGTGCGGCAGGCAAATGGGGGACTGACTACTGGGGCCAGGGGACCCA
GGTCATCGTCTCCTCA SEQ ID NO: 110 (AS07712 sdAb nucleic acid sequence)
CAGATTCAGCTGGTGGAGTCTGGGGGAGGCTCGGTGCAGGCTGGAGGGTCTCTGAGACTCTCCTGTGC
AGCCTCTGCATACACCGACAGACGCTACTGCATGGCCTGGTTCCGCCAGGCTCCAGGGAAGGAGCGCG
AGGGGGTCGCAACTATGGATACTGATGGTAGTACAAGGTACGCAGACTCCGTGAAGGGCCGATTCAC
CATCTCCACAGACAGCGCCAAGAACACTCTGTATCTGCAAATGAACAGCCTGGAACCTGAGGACACTG
CCATGTACTACTGTGCGGTGGGGCCGAACCCGCGATATTGTAGTGGCGCAATCAACACTCGGGGCGCC
GAACACTACTTTGGTTACTGGGGCCAGGGGACCCAGGTCACCGTCTCCTCA SEQ ID NO: 111 (AS07745 sdAb nucleic acid sequence)
CAGATGCAGCTGGTGGAGTCTGGGGGAGGCTTGGTGCAGCCTGGGGGGTCTCTGAGACTCTCCTGTGC
AGCCTCTGGATTCACCTTCAGTAGCTACTACATGAGCTGGGTTCGCCAGGCTCCAGGGAAGGGGCTGG
AGTGGGTGTCCAGTATTTATAGTGATGGTAGTAACACATACTATGCAGACTCCGTGAAGGGCCGATTC
ACCATCTCCAGAGACAACGCCAAGAACACGGTGTATCTGCAAATGAACAGCCTGAAATCTGAGGACA
CGGCCCTGTATTACTGTGCCACCCCAAGGGGTGCTCACGGACCTACATATTGTAGTGGTGGTTACTGCT
ACTACGGGGCCAGGGGACCCAGGTCACCGTCTCCTCA SEQ ID NO: 112 (AS07832 sdAb nucleic acid sequence)
CAGGTTCAGCTGGTGGAGTCTGGGGGAGGCTCGGTGCAGGCTGGAGGGTCTCTGAGACTCTCCTGTGC
AGCCTCTGGATACTACAATAGGTACTGCCTGGGCTGGTTCCGCCAGACTCCAGGGAAGGAGCGCGAGG
CGGTCGCAACTATTGATACGGATGGTAGCACAAGCTACGCAGACTCCGTGAAGGGCCGATTCACCATC
TCCTTTGACAACGCCAAGAACACTCTATATCTGCAAATGAACAGCCTGAAACCTGAGGACACTGCCAT
GTACTACTGTGCGGCAGGGCCGAACCCGCGATATTGTAGTGGCGCGGTCAACACTCGGGGCGCCGAAC
ACTACTTTGGTTACTGGGCCCAGGGGACCCAGGTCACCGTCTCCTCA SEQ ID NO: 113 (A34310 sdAb amino acid sequence; CDRs are underlined)
QVQLVESGGGLVQAGGSLRLSCAAS<u>GFTFDDYAIG</u>WFRQAPGKEREGVS<u>CISSGGTYYADSVKG</u>RFTISSD
NAKNTVFLQMNSLKPEDTAVYYCA<u>VSSLLSVERFPGGHCGPRYGYYRHGY</u>WGQGTQVTVSS SEQ ID NO: 114 (A34311 sdAb amino acid sequence; CDRs are underlined)
QVKLEESGGGLVLPGESLRLSCEAS<u>GRTITTITMG</u>WFRQAPGKERQFVA<u>HSWTDNNPYYADSVKG</u>RFIISR
DNAGNRVYLQMHSLEPEDTAVYYCAA<u>TARRSFVGRQWYTEARQYDY</u>WGQGTQVTVSS SEQ ID NO: 115 (A34313 sdAb amino acid sequence; CDRs are underlined)
QVQLVESGGGLVQAGGSLRLSCATS<u>VRTPLSNFAMG</u>WFRQTPGKEREFVA<u>AISRSGGSTSYADSVKG</u>RFTI
SRDNAKNTVYLEMNSLKGEDTVVYYCAA<u>KIAGMNNIVFIGAPQYNY</u>WGQGTQVTVSS SEQ ID NO: 116 (A34625 sdAb amino acid sequence; CDRs are underlined)
QVKLEESGGGLVQPGGSLRLSCVAS<u>GSIDSTYTMG</u>WYRQAPGKQRELVA<u>SITSSGSTNHADSVKG</u>RFTISR
DNAKNTVYLQMNTLKPEDAAVYYCR<u>YLSVLSAY</u>WGQGTQVTVSS SEQ ID NO: 117 (A36566 sdAb amino acid sequence; CDRs are underlined)
EVQLVESGGGLVQVGDSLRLSCAAS<u>GRSFENYAIG</u>WFRQAPGKEREFVA<u>TISWIPRTAYSTTYYADSVKG</u>R
FTISGDNSKNTVYLQMTSLKPEDTAVYYCAA<u>GGATGPLALDSHYGY</u>WGQGTQVTVSS SEQ ID NO: 118 (A36922 sdAb amino acid sequence; CDRs are underlined)
QVQLVESGGGLVQAGGSLRLSCAAS<u>GRLSRTFTMG</u>WYRQAPGKQRDLVA<u>SITTSGSTNYADSVKG</u>RFTIS
RDNAKNTVILQMNSLVPEDTAVYYCRF<u>LSASTAA</u>WGQGTQVTIST SEQ ID NO: 119 (A37067 sdAb amino acid sequence; CDRs are underlined)
AVQLVDSGGGLVQAGGSLRLSCAAS<u>GSISSLNAMA</u>WYRQGPGKERELVA<u>SITRGGSTAYTDSVKG</u>RFTISR
DNAKNTVYLQMNSLKPEDTAVYYCRA<u>VWGFGDYGS</u>WGQGTQVTVSS

SEQUENCE LISTING

SEQ ID NO: 120 (AS07014 sdAb amino acid sequence; CDRs are underlined)
QVHLVESGGGSVQAGGSLRLSCAAS<u>GYTYSRHCLG</u>WFRQTPGKEREAVA<u>TIDSDGSTSYADSVKG</u>RFTISS
DNAKNTLYLQMNSLKPEDTAMYYCAI<u>GPNPRYCSGAPNTRGAEHYFGY</u>WAQGTQVTVSS SEQ ID NO: 121 (AS07172 sdAb amino acid sequence; CDRs are underlined)
QVKLVESGGGSVQAGGSLRLSCAVS<u>GDDLSNYCMG</u>WVRQAPGKEREEVA<u>TIDYAFKTNYADSVKG</u>RFTIS
KDNAENSLRVNLEMNDLKPDDTAMYYCAA<u>DWSSGGVCFGLADFGT</u>RGQGTQVTVSS SEQ ID NO: 122 (AS07189 sdAb amino acid sequence; CDRs are underlined)
QVQLVESGGGSVQAGGSLRLSCAAS<u>GDSPSVNYMG</u>WFRRAPEKQREQREEVA<u>SIYPTGGTFYTDSVKG</u>RF
TISRDNAKNTLYLQMTALKPEDTAMYYCAA<u>GKWGTDY</u>WGQGTQVIVSS SEQ ID NO: 123 (AS07392 sdAb amino acid sequence; CDRs are underlined)
QVKLVESGGGSVQAGGSLRLSCAAS<u>GDSYSVKYMG</u>WFRRAPGKQRDQREEVA<u>SIYPTGGTFYTDSVKG</u>R
FTISRDNAKSTLYLQMTALKPEDTAMYYCAA<u>GKWGTDY</u>WGQGTQVTVSS SEQ ID NO: 124 (AS07678 sdAb amino acid sequence; CDRs are underlined)
QVHLMESGGGSVQAGGSLRLSCAAS<u>GYTYSRYCLG</u>WFRQTPGKEREAVA<u>TIDIDGSTSYADSVKG</u>RFTISN
DNAKNTLYLQMNILKPEDTAMYYCAA<u>GPNPRYCSGAVYTRGAEHYFGY</u>WGQGTQVTVSS SEQ ID NO: 125 (AS07688 sdAb amino acid sequence; CDRs are underlined)
QIQLVESGGGSVQAGGSLRLSCAAS<u>GDSYSVNYMG</u>WFRRAPGQQREQREEVA<u>SIYATGGTFYRDSVKG</u>RF
TISRDNAKNTLYLQMTALKPEDTAMYYCAA<u>GKWGTDY</u>WGQGTQVIVSS SEQ ID NO: 126 (AS07712 sdAb amino acid sequence; CDRs are underlined)
QIQLVESGGGSVQAGGSLRLSCAAS<u>AYTDRRYCMA</u>WFRQAPGKEREGVA<u>TMDTDGSTRYADSVKG</u>RFTIS
TDSAKNTLYLQMNSLEPEDTAMYYCAV<u>GPNPRYCSGAINTRGAEHYFGY</u>WGQGTQVTVSS SEQ ID NO: 127 (AS07745 sdAb amino acid sequence; CDRs are underlined)
QMQLVESGGGLVQPGGSLRLSCAAS<u>GFTFSSYYMS</u>WVRQAPGKGLEWVS<u>SIYSDGSNTYYADSVKG</u>RFTI
SRDNAKNTVYLQMNSLKSEDTALYYCAT<u>PRGAHGPTYCSGGYCYY</u>GGQGTQVTVSS SEQ ID NO: 128 (AS07832 sdAb amino acid sequence; CDRs are underlined)
QVQLVESGGGSVQAGGSLRLSCAAS<u>GYYNRYCLG</u>WFRQTPGKEREAVA<u>TIDTDGSTSYADSVKG</u>RFTISF
DNAKNTLYLQMNSLKPEDTAMYYCAA<u>GPNPRYCSGAVNTRGAEHYFGY</u>WAQGTQVTVSS SEQ ID NO: 129 (AS02640 humanized sdAb amino acid sequence; CDRs are underlined)
QVQLVESGGGVVQPGRSLRLSCAAS<u>GRTITTITMG</u>WFRQAPGKGLEFVA<u>SHSWTDNNPYYADSVKG</u>RFIIS
RDNSKNRLYLQMNSLRAEDTAVYYCAA<u>TARRSFVGRQWYTEARQYDY</u>WGQGTLVTVSS SEQ ID NO: 130 (A34311 HCAb monomeric form amino acid sequence)
QVKLEESGGGLVLPGESLRLSCEASGRTITTITMGWFRQAPGKERQFVASHSWTDNNPYYADSVKGRFIISR
DNAGNRVYLQMHSLEPEDTAVYYCAATARRSFVGRQWYTEARQYDYWGQGTQVTVSSEPKSSDKTHTS
PPSPAPELLGGPSVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVYTLPPSRDELTKNQVSLTCL
VKGFYPSDIAVEWESNGQPENNYKTTPPVLDSDGSFFLYSKLTVDKSRWQQGNVFSCSVMHEALHNHYTQ
KSLSLSPGK SEQ ID NO: 131 (A34311 HCAb dimeric form amino acid sequence)
QVKLEESGGGLVLPGESLRLSCEASGRTITTITMGWFRQAPGKERQFVASHSWTDNNPYYADSVKGRFIISR
DNAGNRVYLQMHSLEPEDTAVYYCAATARRSFVGRQWYTEARQYDYWGQGTQVTVSSEPKSCDKTHTC
PPCPAPELLGGPSVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVYTLPPSRDELTKNQVSLTCL
VKGFYPSDIAVEWESNGQPENNYKTTPPVLDSDGSFFLYSKLTVDKSRWQQGNVFSCSVMHEALHNHYTQ
KSLSLSPGK SEQ ID NO: 132 (AS02640 HCAb monomeric form amino acid sequence)
QVQLVESGGGVVQPGRSLRLSCAASGRTITTITMGWFRQAPGKGLEFVASHSWTDNNPYYADSVKGRFIIS
RDNSKNRLYLQMNSLRAEDTAVYYCAATARRSFVGRQWYTEARQYDYWGQGTLVTVSSEPKSSDKTHTS
PPSPAPELLGGPSVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVYTLPPSRDELTKNQVSLTCL
VKGFYPSDIAVEWESNGQPENNYKTTPPVLDSDGSFFLYSKLTVDKSRWQQGNVFSCSVMHEALHNHYTQ
KSLSLSPGK SEQ ID NO: 133 (AS02640 HCAb dimeric form amino acid sequence)
QVQLVESGGGVVQPGRSLRLSCAASGRTITTITMGWFRQAPGKGLEFVASHSWTDNNPYYADSVKGRFIIS
RDNSKNRLYLQMNSLRAEDTAVYYCAATARRSFVGRQWYTEARQYDYWGQGTLVTVSSEPKSCDKTHT
CPPCPAPELLGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEKTISKAKGQPREPQVYTLPPSRDELTKNQVSLTC
LVKGFYPSDIAVEWESNGQPENNYKTTPPVLDSDGSFFLYSKLTVDKSRWQQGNVFSCSVMHEALHNHYT
QKSLSLSPGK

TABLE 4

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-2 (BCP-K311) (Keytruda-9GS-A34311) | 134 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK <u>GGGGSGGGS</u>QVKLEESGGGLVLPGESLRLSCEASGRTITTITMGWFRQAP GKERQFVASHSWTDNNPYYADSVKGRFIISRDNAGNRVYLQMHSLEPED TAVYYCAATARRSFVGRQWYTEARQYDYWGQGTQVTVSS | 159 | EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| BCP-311K (A34311-9GS-Keytruda) | 135 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSS<u>GGGGSGGGS</u>QVQLVQSGV EVKKPGASVKVSCKASGYTFTNYYMYWVRQAPGQGLEWMGGINPSNGGT NFNEKFKNRVTLTTDSSTTTAYMELKSLQFDDTAVYYCARRDYRFDMGF DYWGQGTTVTVSSASTKGPSVFPLAPCSRSTSESTAALGCLVKDYFPEPVT VSWNSGALTSGVHTFPAVLQSSGLYSLSSVVTVPSSSLGTKTYTCNVDHK PSNTKVDKRVESKYGPPCPPCPAPEFLGGPSVFLFPPKPKDTLMISRTPEVT CVVVDVSQEDPEVQFNWYVDGVEVHNAKTKPREEQFNSTYRVVSVLTV LHQDWLNGKEYKCKVSNKGLPSSIEKTISKAKGQPREPQVYTLPPSQEEM TKNQVSLTCLVKGFYPSDIAVEWESNGQPENNYKTTPPVLDSDGSFFLYS RLTVDKSRWQEGNVFSCSVMHEALHNHYTQKSLSLSLGK | | |
| Keytruda-hIgG1 hinge-A34311 | 136 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK <u>EPKSCDKTHTCPPCP</u>QVKLEESGGGLVLPGESLRLSCEASGRTITTITMGW FRQAPGKERQFVASHSWTDNNPYYADSVKGRFIISRDNAGNRVYLQMHS LEPEDTAVYYCAATARRSFVGRQWYTEARQYDYWGQGTQVTVSS | | |
| A34311-hIgG1 hinge-Keytruda | 137 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSS<u>EPKSCDKTHTCPPCP</u>QVQLV QSGVEVKKPGASVKVSCKASGYTFTNYYMYWVRQAPGQGLEWMGGINP SNGGTNFNEKFKNRVTLTTDSSTTTAYMELKSLQFDDTAVYYCARRDYR FDMGFDYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK | | |
| Keytruda-A34311 | 138 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSS | | |
| A34311-Keytruda | 139 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSSQVQLVQSGVEVKKPGASVK VSCKASGYTFTNYYMYWVRQAPGQGLEWMGGINPSNGGTNFNEKFKNR VTLTTDSSTTTAYMELKSLQFDDTAVYYCARRDYRFDMGFDYWGQGTT VTVSSASTKGPSVFPLAPCSRSTSESTAALGCLVKDYFPEPVTVSWNSGAL TSGVHTFPAVLQSSGLYSLSSVVTVPSSSLGTKTYTCNVDHKPSNTKVDK RVESKYGPPCPPCPAPEFLGGPSVFLFPPKPKDTLMISRTPEVTCVVVDVSQ EDPEVQFNWYVDGVEVHNAKTKPREEQFNSTYRVVSVLTVLHQDWLNG KEYKCKVSNKGLPSSIEKTISKAKGQPREPQVYTLPPSQEEMTKNQVSLTC LVKGFYPSDIAVEWESNGQPENNYKTTPPVLDSDGSFFLYSRLTVDKSRW QEGNVFSCSVMHEALHNHYTQKSLSLSLGK | | |

TABLE 4-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| Keytruda-9GS-AS22640 | 140 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK <u>GGGGSGGGS</u>QVQLVESGGGVVQPGRSLRLSCAASGRTITTITMGWFRQAP GKGLEFVASHSWTDNNPYYADSVKGRFIISRDNSKNRLYLQMNSLRAEDT AVYYCAATARRSFVGRQWYTEARQYDYWGQGTLVTVSS | | |
| AS02640-9GS-Keytruda | 141 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSS<u>GGGGSGGGS</u>QVQLVQSGV EVKKPGASVKVSCKASGYTFTNYYMYWVRQAPGQGLEWMGGINPSNGG TNFNEKFKNRVTLTTDSSTTTAYMELKSLQFDDTAVYYCARRDYRFDMG FDYWGQGTTVTVSSASTKGPSVFPLAPCSRSTSESTAALGCLVKDYFPEPV TVSWNSGALTSGVHTFPAVLQSSGLYSLSSVVTVPSSSLGTKTYTCNVDH KPSNTKVDKRVESKYGPPCPPCPAPEFLGGPSVFLFPPKPKDTLMISRTPEV TCVVVDVSQEDPEVQFNWYVDGVEVHNAKTKPREEQFNSTYRVVSVLT VLHQDWLNGKEYKCKVSNKGLPSSIEKTISKAKGQPREPQVYTLPPSQEE MTKNQVSLTCLVKGFYPSDIAVEWESNGQPENNYKTTPPVLDSDGSFFLY SRLTVDKSRWQEGNVFSCSVMHEALHNHYTQKSLSLSLGK | | |
| Keytruda-hIgG1 hinge-AS02640 | 142 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK <u>EPKSCDKTHTCPPCP</u>QVQLVESGGGVVQPGRSLRLSCAASGRTITTITMG WFRQAPGKGLEFVASHSWTDNNPYYADSVKGRFIISRDNSKNRLYLQMN SLRAEDTAVYYCAATARRSFVGRQWYTEARQYDYWGQGTLVTVSS | | |
| AS02640-hIgG1 hinge-Keytruda | 143 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSS<u>EPKSCDKTHTCPPCP</u>QVQL VQSGVEVKKPGASVKVSCKASGYTFTNYYMYWVRQAPGQGLEWMGGIN PSNGGTNFNEKFKNRVTLTTDSSTTTAYMELKSLQFDDTAVYYCARRD YRFDMGFDYWGQGTTVTVSSASTKGPSVFPLAPCSRSTSESTAALGCLVK DYFPEPVTVSWNSGALTSGVHTFPAVLQSSGLYSLSSVVTVPSSSLGTKTY TCNVDHKPSNTKVDKRVESKYGPPCPPCPAPEFLGGPSVFLFPPKPKDTLM ISRTPEVTCVVVDVSQEDPEVQFNWYVDGVEVHNAKTKPREEQFNSTYR VVSVLTVLHQDWLNGKEYKCKVSNKGLPSSIEKTISKAKGQPREPQVYTL PPSQEEMTKNQVSLTCLVKGFYPSDIAVEWESNGQPENNYKTTPPVLDSD GSFFLYSRLTVDKSRWQEGNVFSCSVMHEALHNHYTQKSLSLSLGK | | |
| Keytruda-AS02640 | 144 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSS | | |
| AS02640-Keytruda | 145 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSSQVQLVQSGVEVKKPGASV KVSCKASGYTFTNYYMYWVRQAPGQGLEWMGGINPSNGGTNFNEKFKN RVTLTTDSSTTTAYMELKSLQFDDTAVYYCARRDYRFDMGFDYWGQGT TVTVSSASTKGPSVFPLAPCSRSTSESTAALGCLVKDYFPEPVTVSWNSGA LTSGVHTFPAVLQSSGLYSLSSVVTVPSSSLGTKTYTCNVDHKPSNTKVDK RVESKYGPPCPPCPAPEFLGGPSVFLFPPKPKDTLMISRTPEVTCVVVDVSQ EDPEVQFNWYVDGVEVHNAKTKPREEQFNSTYRVVSVLTVLHQDWLNG KEYKCKVSNKGLPSSIEKTISKAKGQPREPQVYTLPPSQEEMTKNQVSLTC LVKGFYPSDIAVEWESNGQPENNYKTTPPVLDSDGSFFLYSRLTVDKSRW QEGNVFSCSVMHEALHNHYTQKSLSLSLGK | | |

TABLE 4-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| Opdivo-9GS-A34311 | 146 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGK<u>GGGGSGG GS</u>QVKLEESGGGLVLPGESLRLSCEASGRTITTITMGWFRQAPGKERQFVA SHSWTDNNPYYADSVKGRFIISRDNAGNRVYLQMEISLEPEDTAVYYCAA TARRSFVGRQWYTEARQYDYWGQGTQVTVSS | 161 | EIVLTQSP ATLSLSP GERATLS CRASQSV SSYLAWY QQKPGQ APRLLIY DASNRAT GIPARFSG SGSGTDF TLTISSLE PEDFAVY YCQQSSN WPRTFGQ GTKVEIK RTVAAPS VFIFPPSD EQLKSGT ASVVCLL NNFYPRE AKVQWK VDNALQS GNSQESV TEQDSKD STYSLSST LTLSKAD YEKHKV YACEVTH QGLSSPV TKSFNRG EC |
| A34311-9GS-Opdivo | 147 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSS<u>GGGGSGGGS</u>QVQLVESGGG VVQPGRSLRLDCKASGITFSNSGMHWVRQAPGKGLEWVAVIWYDGSKR YYADSVKGRFTISRDNSKNTLFLQMNSLRAEDTAVYYCATNDDYWGQG TLVTVSSASTKGPSVFPLAPCSRSTSESTAALGCLVKDYFPEPVTVSWNSG ALTSGVHTFPAVLQSSGLYSLSSVVTVPSSSLGTKTYTCNVDHKPSNTKVD KRVESKYGPPCPPCPAPEFLGGPSVFLFPPKPKDTLMISRTPEVTCVVVDVS QEDPEVQFNWYVDGVEVHNAKTKPREEQFNSTYRVVSVLTVLHQDWLN GKEYKCKVSNKGLPSSIEKTISKAKGQPREPQVYTLPPSQEEMTKNQVSLT CLVKGFYPSDIAVEWESNGQPENNYKTTPPVLDSDGSFFLYSRLTVDKSR WQEGNVFSCSVMHEALHNHYTQKSLSLSLGK | | |
| Opdivo-hIgG1 hinge-A34311 | 148 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGK<u>EPKSCDK THTCPPCP</u>QVKLEESGGGLVLPGESLRLSCEASGRTITTITMGWFRQAPGK ERQFVASHSWTDNNPYYADSVKGRFIISRDNAGNRVYLQMHSLEPEDTA VYYCAATARRSFVGRQWYTEARQYDYWGQGTQVTVSS | | |
| A34311-hIgG1 hinge-Opdivo | 149 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSS<u>EPKSCDKTHTCPPCP</u>QVQLV ESGGGVVQPGRSLRLDCKASGITFSNSGMHWVRQAPGKGLEWVAVIWY DGSKRYYADSVKGRFTISRDNSKNTLFLQMNSLRAEDTAVYYCATNDDY WGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPS NTKVDKRVESKYGPPCPPCPAPEFLGGPSVFLFPPKPKDTLMISRTPEVTCV VVDVSQEDPEVQFNWYVDGVEVHNAKTKPREEQFNSTYRVVSVLTVLH QDWLNGKEYKCKVSNKGLPSSIEKTISKAKGQPREPQVYTLPPSQEEMTK NQVSLTCLVKGFYPSDIAVEWESNGQPENNYKTTPPVLDSDGSFFLYSRLT VDKSRWQEGNVFSCSVMHEALHNHYTQKSLSLSLGK | | |
| Opdivo-A34311 | 150 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGKQVKLEES GGGLVLPGESLRLSCEASGRTITTITMGWFRQAPGKERQFVASHSWTDNN PYYADSVKGRFIISRDNAGNRVYLQMHSLEPEDTAVYYCAATARRSFVGR QWYTEARQYDYWGQGTQVTVSS | | |
| A34311-Opdivo | 151 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSSQVQLVESGGGVVQPGRSLR LDCKASGITFSNSGMHWVRQAPGKGLEWVAVIWYDGSKRYYADSVKGR FTISRDNSKNTLFLQMNSLRAEDTAVYYCATNDDYWGQGTLVTVSSAST KGPSVFPLAPCSRSTSESTAALGCLVKDYFPEPVTVSWNSGALTSGVHTFP AVLQSSGLYSLSSVVTVPSSSLGTKTYTCNVDHKPSNTKVDKRVESKYGP PCPPCPAPEFLGGPSVFLFPPKPKDTLMISRTPEVTCVVVDVSQEDPEVQFN WYVDGVEVHNAKTKPREEQFNSTYRVVSVLTVLHQDWLNGKEYKCKVS NKGLPSSIEKTISKAKGQPREPQVYTLPPSQEEMTKNQVSLTCLVKGFYPS DIAVEWESNGQPENNYKTTPPVLDSDGSFFLYSRLTVDKSRWQEGNVFSC SVMHEALHNHYTQKSLSLSLGK | | |

TABLE 4-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| Opdivo-9GS-AS02640 | 152 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGK<u>GGGGSGG GS</u>QVQLVESGGGVVQPGRSLRLSCAASGRTITTITMGWFRQAPGKGLEFV ASHSWTDNNPYYADSVKGRFIISRDNSKNRLYLQMNSLRAEDTAVYYCA ATARRSFVGRQWYTEARQYDYWGQGTLVTVSS | | |
| AS02640-9GS-Opdivo | 153 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSS<u>GGGGSGGGGS</u>QVQLVESGG GVVQPGRSLRLDCKASGITFSNSGMHWVRQAPGKGLEWVAVIWYDGSK RYYADSVKGRFTISRDNSKNTLFLQMNSLRAEDTAVYYCATNDDYWGQ GTLVTVSSASTKGPSVFPLAPCSRSTSESTAALGCLVKDYFPEPVTVSWNS GALTSGVHTFPAVLQSSGLYSLSSVVTVPSSSLGTKTYTCNVDHKPSNTKV DKRVESKYGPPCPPCPAPEFLGGPSVFLFPPKPKDTLMISRTPEVTCVVVD VSQEDPEVQFNWYVDGVEVHNAKTKPREEQFNSTYRVVSVLTVLHQDW LNGKEYKCKVSNKGLPSSIEKTISKAKGQPREPQVYTLPPSQEEMTKNQVS LTCLVKGFYPSDIAVEWESNGQPENNYKTTPPVLDSDGSFFLYSRLTVDKS RWQEGNVFSCSVMHEALHNHYTQKSLSLSLGK | | |
| Opdivo-hIgG1 hinge-AS02640 | 154 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGK<u>EPKSCDK THTCPPCP</u>QVQLVESGGGVVQPGRSLRLSCAASGRTITTITMGWFRQAPG KGLEFVASHSWTDNNPYYADSVKGRFIISRDNSKNRLYLQMNSLRAEDTA VYYCAATARRSFVGRQWYTEARQYDYWGQGTLVTVSS | | |
| AS02640-hIgG1 hinge-Opdivo | 155 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSS<u>EPKSCDKTHTCPPCP</u>QVQL VESGGGVVQPGRSLRLDCKASGITFSNSGMHWVRQAPGKGLEWVAVIW YDGSKRYYADSVKGRFTISRDNSKNTLFLQMNSLRAEDTAVYYCATNDD YWGQGTLVTVSSASTKGPSVFPLAPCSRSTSESTAALGCLVKDYFPEPVTV SWNSGALTSGVHTFPAVLQSSGLYSLSSVVTVPSSSLGTKTYTCNVDHKPS NTKVDKRVESKYGPPCPPCPAPEFLGGPSVFLFPPKPKDTLMISRTPEVTCV VVDVSQEDPEVQFNWYVDGVEVHNAKTKPREEQFNSTYRVVSVLTVLH QDWLNGKEYKCKVSNKGLPSSIEKTISKAKGQPREPQVYTLPPSQEEMTK NQVSLTCLVKGFYPSDIAVEWESNGQPENNYKTTPPVLDSDGSFFLYSRLT VDKSRWQEGNVFSCSVMHEALHNHYTQKSLSLSLGK | | |
| Opdivo-AS02640 | 156 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGKQVQLVES GGGVVQPGRSLRLSCAASGRTITTITMGWFRQAPGKGLEFVASHSWTDN NPYYADSVKGRFIISRDNSKNRLYLQMNSLRAEDTAVYYCAATARRSFVG RQWYTEARQYDYWGQGTLVTVSS | | |
| AS02640-Opdivo | 157 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSSQVQLVESGGGVVQPGRSL RLDCKASGITFSNSGMHWVRQAPGKGLEWVAVIWYDGSKRYYADSVKG RFTISRDNSKNTLFLQMNSLRAEDTAVYYCATNDDYWGQGTLVTVSSAS TKGPSVFPLAPCSRSTSESTAALGCLVKDYFPEPVTVSWNSGALTSGVHTF PAVLQSSGLYSLSSVVTVPSSSLGTKTYTCNVDHKPSNTKVDKRVESKYG PPCPPCPAPEFLGGPSVFLFPPKPKDTLMISRTPEVTCVVVDVSQEDPEVQF NWYVDGVEVHNAKTKPREEQFNSTYRVVSVLTVLHQDWLNGKEYKCK VSNKGLPSSIEKTISKAKGQPREPQVYTLPPSQEEMTKNQVSLTCLVKGFY PSDIAVEWESNGQPENNYKTTPPVLDSDGSFFLYSRLTVDKSRWQEGNVF SCSVMHEALHNHYTQKSLSLSLGK | | |

TABLE 4-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|

SEQ ID NO: 158 (Keytruda® heavy chain amino acid sequence)
QVQLVQSGVEVKKPGASVKVSCKASGYTFTNYYMYWVRQAPGQGLEWMGGINPSNGGTNFNEKFKNRV
TLTTDSSTTTAYMELKSLQFDDTAVYYCARRDYRFDMGFDYWGQGTTVTVSSASTKGPSVFPLAPCSRSTS
ESTAALGCLVKDYFPEPVTVSWNSGALTSGVHTFPAVLQSSGLYSLSSVVTVPSSSLGTKTYTCNVDHKPS
NTKVDKRVESKYGPPCPPCPAPEFLGGPSVFLFPPKPKDTLMISRTPEVTCVVVDVSQEDPEVQFNWYVDG
VEVHNAKTKPREEQFNSTYRVVSVLTVLHQDWLNGKEYKCKVSNKGLPSSIEKTISKAKGQPREPQVYTLP
PSQEEMTKNQVSLTCLVKGFYPSDIAVEWESNGQPENNYKTTPPVLDSDGSFFLYSRLTVDKSRWQEGNVF
SCSVMHEALHNHYTQKSLSLSLGK SEQ ID NO: 160 (Opdivo® heavy chain amino acid sequence)
QVQLVESGGGVVQPGRSLRLDCKASGITFSNSGMHWVRQAPGKGLEWVAVIWYDGSKRYYADSVKGRF
TISRDNSKNTLFLQMNSLRAEDTAVYYCATNDDYWGQGTLVTVSSASTKGPSVFPLAPCSRSTSESTAALG
CLVKDYFPEPVTVSWNSGALTSGVHTFPAVLQSSGLYSLSSVVTVPSSSLGTKTYTCNVDHKPSNTKVDKR
VESKYGPPCPPCPAPEFLGGPSVFLFPPKPKDTLMISRTPEVTCVVVDVSQEDPEVQFNWYVDGVEVHNAK
TKPREEQFNSTYRVVSVLTVLHQDWLNGKEYKCKVSNKGLPSSIEKTISKAKGQPREPQVYTLPPSQEEMT
KNQVSLTCLVKGFYPSDIAVEWESNGQPENNYKTTPPVLDSDGSFFLYSRLTVDKSRWQEGNVFSCSVMH
EALHNHYTQKSLSLSLGK SEQ ID NO: 162 (linker peptide (9GS) amino acid sequence)
GGGGSGGGS SEQ ID NO: 163 (human IgG1 (hIgG1) hinge amino acid sequence)
EPKSCDKTHTCPPCP

TABLE 5

Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| Tecentriq-9GS-A34311 | 171 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK GGGGSGGGSQVKLEESGGGLVLPGESLRLSCEASGRTITTITMGWFRQAP GKERQFVASHSWTDNNPYYADSVKGRFIISRDNAGNRVYLQMHSLEPED TAVYYCAATARRSFVGRQWYTEARQYDYWGQGTQVTVSS | 196 | DIQMTQS PSSLSASV GDRVTIT CRASQDV STAVAW YQQKPG KAPKLLI YSASFLY SGVPSRF SGSGSGT DFTLTISS LQPEDFA |
| A34311-9GS-Tecentriq | 172 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSSGGGGSGGGSEVQLVESGGG LVQPGGSLRLSCAASGFTFSDSWIHWVRQAPGKGLEWVAWISPYGGSTY YADSVKGRFTISADTSKNTAYLQMNSLRAEDTAVYYCARRHWPGGFDY WGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSN TKVDKKVEPKSCDKTHTCPPCPAPELLGGPSVFLFPPKPKDTLMISRTPEV TCVVVDVSHEDPEVKFNWYVDGVEVHNAKTKPREEQYASTYRVVSVLT VLHQDWLNGKEYKCKVSNKALPAPIEKTISKAKGQPREPQVYTLPPSREE MTKNQVSLTCLVKGFYPSDIAVEWESNGQPENNYKTTPPVLDSDGSFFLY SKLTVDKSRWQQGNVFSCSVMHEALHNHYTQKSLSLSPGK | | TYYCQQ YLYHPAT FGQGTKV EIKRTVA APSVFIFP PSDEQLK SGTASVV CLLNNFY PREAKVQ WKVDNA LQSGNSQ ESVTEQD SKDSTYS LSSTLTLS KADYEK HKVYAC EVTHQGL SSPVTKSF NRGEC |
| Tecentriq-hIgG1 hinge-A34311 | 173 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK EPKSCDKTHTCPPCPQVKLEESGGGLVLPGESLRLSCEASGRTITTITMGW FRQAPGKERQFVASHSWTDNNPYYADSVKGRFIISRDNAGNRVYLQMHS LEPEDTAVYYCAATARRSFVGRQWYTEARQYDYWGQGTQVTVSS | | |

TABLE 5-continued

Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| A34311-hIgG1 hinge-Tecentriq | 174 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSS<u>EPKSCDKTHTCPPCP</u>EVQLV ESGGGLVQPGGSLRLSCAASGFTFSDSWIHWVRQAPGKGLEWVAWISPY GGSTYYADSVKGRFTISADTSKNTAYLQMNSLRAEDTAVYYCARRHWPG GFDYWGQGTLVTVSSASTKGPSVFPLAPSSKSTSGGTAALGCLVKDYFPE PVTVSWNSGALTSGVHTFPAVLQSSGLYSLSSVVTVPSSSLGTQTYICNVN HKPSNTKVDKKVEPKSCDKTHTCPPCPAPELLGGPSVFLFPPKPKDTLMIS RTPEVTCVVVDVSHEDPEVKFNWYVDGVEVHNAKTKPREEQYASTYRV VSVLTVLHQDWLNGKEYKCKVSNKALPAPIEKTISKAKGQPREPQVYTLP PSREEMTKNQVSLTCLVKGFYPSDIAVEWESNGQPENNYKTTPPVLDSDG SFFLYSKLTVDKSRWQQGNVFSCSVMHEALHNHYTQKSLSLSPGK | | |
| Tecentriq-A34311 | 175 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSS | | |
| A34311-Tecentriq | 176 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSSEVQLVESGGGLVQPGGSLR LSCAASGFTFSDSWIHWVRQAPGKGLEWVAWISPYGGSTYYADSVKGRF TISADTSKNTAYLQMNSLRAEDTAVYYCARRHWPGGFDYWGQGTLVTV SSASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSH EDPEVKFNWYVDGVEVHNAKTKPREEQYASTYRVVSVLTVLHQDWLNG KEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRW QQGNVFSCSVMHEALHNHYTQKSLSLSPGK | | |
| Tecentriq-9GS-AS02640 | 177 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK <u>GGGGSGGGS</u>QVQLVESGGGVVQPGRSLRLSCAASGRTITTITMGWFRQAP GKGLEFVASHSWTDNNPYYADSVKGRFIISRDNSKNRLYLQMNSLRAEDT AVYYCAATARRSFVGRQWYTEARQYDYWGQGTLVTVSS | | |
| AS02640-9GS-Tecentriq | 178 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSS<u>GGGGSGGGS</u>EVQLVESGG GLVQPGGSLRLSCAASGFTFSDSWIHWVRQAPGKGLEWVAWISPYGGST YYADSVKGRFTISADTSKNTAYLQMNSLRAEDTAVYYCARRHWPGGFD YWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKP SNTKVDKKVEPKSCDKTHTCPPCPAPELLGGPSVFLFPPKPKDTLMISRTPE VTCVVVDVSHEDPEVKFNWYVDGVEVHNAKTKPREEQYASTYRVVSVL TVLHQDWLNGKEYKCKVSNKALPAPIEKTISKAKGQPREPQVYTLPPSRE EMTKNQVSLTCLVKGFYPSDIAVEWESNGQPENNYKTTPPVLDSDGSFFL YSKLTVDKSRWQQGNVFSCSVMHEALHNHYTQKSLSLSPGK | | |
| Tecentriq-hIgG1 hinge-AS02640 | 179 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK <u>EPKSCDKTHTCPPCP</u>QVQLVESGGGVVQPGRSLRLSCAASGRTITTITMG WFRQAPGKGLEFVASHSWTDNNPYYADSVKGRFIISRDNSKNRLYLQMN SLRAEDTAVYYCAATARRSFVGRQWYTEARQYDYWGQGTLVTVSS | | |

TABLE 5-continued

Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| AS02640-hIgG1 hinge-Tecentriq | 180 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSS<u>EPKSCDKTHTCPPCP</u>EVQL VESGGGLVQPGGSLRLSCAASGFTFSDSWIHWVRQAPGKGLEWVAWISP YGGSTYYADSVKGRFTISADTSKNTAYLQMNSLRAEDTAVYYCARRHWP GGFDYWGQGTLVTVSSASTKGPSVFPLAPSSKSTSGGTAALGCLVKDYFP EPVTVSWNSGALTSGVHTFPAVLQSSGLYSLSSVVTVPSSSLGTQTYICNV NHKPSNTKVDKKVEPKSCDKTHTCPPCPAPELLGGPSVFLFPPKPKDTLMI SRTPEVTCVVVDVSHEDPEVKFNWYVDGVEVHNAKTKPREEQYASTYRV VSVLTVLHQDWLNGKEYKCKVSNKALPAPIEKTISKAKGQPREPQVYTLP PSREEMTKNQVSLTCLVKGFYPSDIAVEWESNGQPENNYKTTPPVLDSDG SFFLYSKLTVDKSRWQQGNVFSCSVMHEALHNHYTQKSLSLSPGK | | |
| Tecentriq-AS02640 | 181 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSS | | |
| AS02640-Tecentriq | 182 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSSEVQLVESGGGLVQPGGSL RLSCAASGFTFSDSWIHWVRQAPGKGLEWVAWISPYGGSTYYADSVKGR FTISADTSKNTAYLQMNSLRAEDTAVYYCARRHWPGGFDYWGQGTLVT VSSASTKGPSVFPLAPSSKSTSGGTAALGCLVKDYFPEPVTVSWNSGALTS GVHTFPAVLQSSGLYSLSSVVTVPSSSLGTQTYICNVNHKPSNTKVDKKVE PKSCDKTHTCPPCPAPELLGGPSVFLFPPKPKDTLMISRTPEVTCVVVDVS HEDPEVKFNWYVDGVEVHNAKTKPREEQYASTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSR WQQGNVFSCSVMHEALHNHYTQKSLSLSPGK | | |
| Durvalumab-9GS-A34311 | 183 | EVQLVESGGGLVQPGGSLRLSCAASGFTFSRYWMSWVRQAPGKGLEWV ANIKQDGSEKYYVDSVKGRFTISRDNAKNSLYLQMNSLRAEDTAVYYCA REGGWFGELAFDYWGQGTLVTVSSASTKGPSVFPLAPSSKSTSGGTAALG CLVKDYFPEPVTVSWNSGALTSGVHTFPAVLQSSGLYSLSSVVTVPSSSLG TQTYICNVNHKPSNTKVDKRVEPKSCDKTHTCPPCPAPEFEGGPSVFLFPP KPKDTLMISRTPEVTCVVVDVSHEDPEVKFNWYVDGVEVHNAKTKPREE QYNSTYRVVSVLTVLHQDWLNGKEYKCKVSNKALPASIEKTISKAKGQ REPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSL SPGK<u>GGGGSGGGS</u>QVKLEESGGGLVLPGESLRLSCEASGRTITTITMGWFR QAPGKERQFVASHSWTDNNPYYADSVKGRFIISRDNAGNRVYLQMHSLE PEDTAVYYCAATARRSFVGRQWYTEARQYDYWGQGTQVTVSS | 198 | EIVLTQSP GTLSLSP GERATLS CRASQRV SSSYLAW YQQKPG QAPRLLI YDASSRA TGIPDRFS GSGSGTD FTLTISRL EPEDFAV |
| A34311-9GS-Durvalumab | 184 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSS<u>GGGGSGGGS</u>EVQLVESGGG LVQPGGSLRLSCAASGFTFSRYWMSWVRQAPGKGLEWVANIKQDGSEK YYVDSVKGRFTISRDNAKNSLYLQMNSLRAEDTAVYYCAREGGWFGELA FDYWGQGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNH KPSNTKVDKRVEPKSCDKTHTCPPCPAPEFEGGPSVFLFPPKPKDTLMISRT PEVTCVVVDVSHEDPEVKFNWYVDGVEVHNAKTKPREEQYNSTYRVVS VLTVLHQDWLNGKEYKCKVSNKALPASIEKTISKAKGQPREPQVYTLPPS REEMTKNQVSLTCLVKGFYPSDIAVEWESNGQPENNYKTTPPVLDSDGSF FLYSKLTVDKSRWQQGNVFSCSVMHEALHNHYTQKSLSLSPGK | | YYCQQY GSLPWTF GQGTKVE IKRTVAA PSVFIFPP SDEQLKS GTASVVC LLNNFYP REAKVQ WKVDNA LQSGNSQ ESVTEQD |
| Durvalumab-hIgG1 hinge-A34311 | 185 | EVQLVESGGGLVQPGGSLRLSCAASGFTFSRYWMSWVRQAPGKGLEWV ANIKQDGSEKYYVDSVKGRFTISRDNAKNSLYLQMNSLRAEDTAVYYCA REGGWFGELAFDYWGQGTLVTVSSASTKGPSVFPLAPSSKSTSGGTAALG CLVKDYFPEPVTVSWNSGALTSGVHTFPAVLQSSGLYSLSSVVTVPSSSLG TQTYICNVNHKPSNTKVDKRVEPKSCDKTHTCPPCPAPEFEGGPSVFLFPP KPKDTLMISRTPEVTCVVVDVSHEDPEVKFNWYVDGVEVHNAKTKPREE QYNSTYRVVSVLTVLHQDWLNGKEYKCKVSNKALPASIEKTISKAKGQP REPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSL SPGK<u>EPKSCDKTHTCPPCP</u>QVKLEESGGGLVLPGESLRLSCEASGRTITTIT MGWFRQAPGKERQFVASHSWTDNNPYYADSVKGRFIISRDNAGNRVYLQ MHSLEPEDTAVYYCAATARRSFVGRQWYTEARQYDYWGQGTQVTVSS | | SKDSTYS LSSTLTLS KADYEK IIKVYAC EVTHQGL SSPVTKSF NRGEC |

TABLE 5-continued

Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| A34311-hIgG1 hinge-Durvalumab | 186 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSS<u>EPKSCDKTHTCPPCP</u>EVQLV ESGGGLVQPGGSLRLSCAASGFTFSRYWMSWVRQAPGKGLEWVANIKQ DGSEKYYVDSVKGRFTISRDNAKNSLYLQMNSLRAEDTAVYYCAREGG WFGELAFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKRVEPKSCDKTHTCPPCPAPEFEGGPSVFLFPPKPKD TLMISRTPEVTCVVVDVSHEDPEVKFNWYVDGVEVHNAKTKPREEQYNS TYRVVSVLTVLHQDWLNGKEYKCKVSNKALPASIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK | | |
| Durvalumab-A34311 | 187 | EVQLVESGGGLVQPGGSLRLSCAASGFTFSRYWMSWVRQAPGKGLEWV ANIKQDGSEKYYVDSVKGRFTISRDNAKNSLYLQMNSLRAEDTAVYYCA REGGWFGELAFDYWGQGTLVTVSSASTKGPSVFPLAPSSKSTSGGTAALG CLVKDYFPEPVTVSWNSGALTSGVHTFPAVLQSSGLYSLSSVVTVPSSSLG TQTYICNVNHKPSNTKVDKRVEPKSCDKTHTCPPCPAPEFEGGPSVFLFPP KPKDTLMISRTPEVTCVVVDVSHEDPEVKFNWYVDGVEVHNAKTKPREE QYNSTYRVVSVLTVLHQDWLNGKEYKCKVSNKALPASIEKTISKAKGQP REPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSL SPGKQVKLEESGGGLVLPGESLRLSCEASGRTITTITMGWFRQAPGKERQF VASHSWTDNNPYYADSVKGRFIISRDNAGNRVYLQMHSLEPEDTAVYYC AATARRSFVGRQWYTEARQYDYWGQGTQVTVSS | | |
| A34311-Durvalumab | 188 | QVKLEESGGGLVLPGESLRLSCEASGRTITTITMGWFRQAPGKERQFVASH SWTDNNPYYADSVKGRFIISRDNAGNRVYLQMHSLEPEDTAVYYCAATA RRSFVGRQWYTEARQYDYWGQGTQVTVSSEVQLVESGGGLVQPGGSVKGR LSCAASGFTFSRYWMSWVRQAPGKGLEWVANIKQDGSEKYYVDSVKGR FTISRDNAKNSLYLQMNSLRAEDTAVYYCAREGGWFGELAFDYWGQGT LVTVSSASTKGPSVFPLAPSSKSTSGGTAALGCLVKDYFPEPVTVSWNSGA LTSGVHTFPAVLQSSGLYSLSSVVTVPSSSLGTQTYICNVNHKPSNTKVDK RVEPKSCDKTHTCPPCPAPEFEGGPSVFLFPPKPKDTLMISRTPEVTCVVVD VSHEDPEVKFNWYVDGVEVHNAKTKPREEQYNSTYRVVSVLTVLHQDW LNGKEYKCKVSNKALPASIEKTISKAKGQPREPQVYTLPPSREEMTKNQV SLTCLVKGFYPSDIAVEWESNGQPENNYKTTPPVLDSDGSFFLYSKLTVDK SRWQQGNVFSCSVMHEALHNHYTQKSLSLSPGK | | |
| Durvalumab-9GS-AS02640 | 189 | EVQLVESGGGLVQPGGSLRLSCAASGFTFSRYWMSWVRQAPGKGLEWV ANIKQDGSEKYYVDSVKGRFTISRDNAKNSLYLQMNSLRAEDTAVYYCA REGGWFGELAFDYWGQGTLVTVSSASTKGPSVFPLAPSSKSTSGGTAALG CLVKDYFPEPVTVSWNSGALTSGVHTFPAVLQSSGLYSLSSVVTVPSSSLG TQTYICNVNHKPSNTKVDKRVEPKSCDKTHTCPPCPAPEFEGGPSVFLFPP KPKDTLMISRTPEVTCVVVDVSHEDPEVKFNWYVDGVEVHNAKTKPREE QYNSTYRVVSVLTVLHQDWLNGKEYKCKVSNKALPASIEKTISKAKGQP REPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSL SPGK<u>GGGGSGGGS</u>QVQLVESGGGVVQPGRSLRLSCAASGRTITTITMGWF RQAPGKGLEFVASHSWTDNNPYYADSVKGRFIISRDNSKNRLYLQMNSLR AEDTAVYYCAATARRSFVGRQWYTEARQYDYWGQGTLVTVSS | | |
| AS02640-9GS-Durvalumab | 190 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSS<u>GGGGSGGGS</u>EVQLVESGG GLVQPGGSLRLSCAASGFTFSRYWMSWVRQAPGKGLEWVANIKQDGSE KYYVDSVKGRFTISRDNAKNSLYLQMNSLRAEDTAVYYCAREGGWFGEL AFDYWGQGTLVTVSSASTKGPSVFPLAPSSKSTSGGTAALGCLVKDYFPE PVTVSWNSGALTSGVHTFPAVLQSSGLYSLSSVVTVPSSSLGTQTYICNVN HKPSNTKVDKRVEPKSCDKTHTCPPCPAPEFEGGPSVFLFPPKPKDTLMIS RTPEVTCVVVDVSHEDPEVKFNWYVDGVEVHNAKTKPREEQYNSTYRV VSVLTVLHQDWLNGKEYKCKVSNKALPASIEKTISKAKGQPREPQVYTLP PSREEMTKNQVSLTCLVKGFYPSDIAVEWESNGQPENNYKTTPPVLDSDG SFFLYSKLTVDKSRWQQGNVFSCSVMHEALHNHYTQKSLSLSPGK | | |
| Durvalumab-hIgG1 hinge-AS02640 | 191 | EVQLVESGGGLVQPGGSLRLSCAASGFTFSRYWMSWVRQAPGKGLEWV ANIKQDGSEKYYVDSVKGRFTISRDNAKNSLYLQMNSLRAEDTAVYYCA REGGWFGELAFDYWGQGTLVTVSSASTKGPSVFPLAPSSKSTSGGTAALG CLVKDYFPEPVTVSWNSGALTSGVHTFPAVLQSSGLYSLSSVVTVPSSSLG TQTYICNVNHKPSNTKVDKRVEPKSCDKTHTCPPCPAPEFEGGPSVFLFPP KPKDTLMISRTPEVTCVVVDVSHEDPEVKFNWYVDGVEVHNAKTKPREE QYNSTYRVVSVLTVLHQDWLNGKEYKCKVSNKALPASIEKTISKAKGQP REPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSL SPGK<u>EPKSCDKTHTCPPCP</u>QVQLVESGGGVVQPGRSLRLSCAASGRTITTI TMGWFRQAPGKGLEFVASHSWTDNNPYYADSVKGRFIISRDNSKNRLYL QMNSLRAEDTAVYYCAATARRSFVGRQWYTEARQYDYWGQGTLVTVSS | | |

TABLE 5-continued

Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| AS02640-hIgG1 hinge-Durvalumab | 192 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSS<u>EPKSCDKTHTCPPCP</u>EVQL VESGGGLVQPGGSLRLSCAASGFTFSRYWMSWVRQAPGKGLEWVANIK QDGSEKYYVDSVKGRFTISRDNAKNSLYLQMNSLRAEDTAVYYCAREGG WFGELAFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKRVEPKSCDKTHTCPPCPAPEFEGGPSVFLFPPKPKD TLMISRTPEVTCVVVDVSHEDPEVKFNWYVDGVEVHNAKTKPREEQYNS TYRVVSVLTVLHQDWLNGKEYKCKVSNKALPASIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK | | |
| Durvalumab-AS02640 | 193 | EVQLVESGGGLVQPGGSLRLSCAASGFTFSRYWMSWVRQAPGKGLEWV ANIKQDGSEKYYVDSVKGRFTISRDNAKNSLYLQMNSLRAEDTAVYYCA REGGWFGELAFDYWGQGTLVTVSSASTKGPSVFPLAPSSKSTSGGTAALG CLVKDYFPEPVTVSWNSGALTSGVHTFPAVLQSSGLYSLSSVVTVPSSSLG TQTYICNVNHKPSNTKVDKRVEPKSCDKTHTCPPCPAPEFEGGPSVFLFPP KPKDTLMISRTPEVTCVVVDVSHEDPEVKFNWYVDGVEVHNAKTKPREE QYNSTYRVVSVLTVLHQDWLNGKEYKCKVSNKALPASIEKTISKAKGQP REPQVYTLPPSREEMTKNQVSLTCLVKGFYPSDIAVEWESNGQPENNYKT TPPVLDSDGSFFLYSKLTVDKSRWQQGNVFSCSVMHEALHNHYTQKSLSL SPGKQVQLVESGGGVVQPGRSLRLSCAASGRTITTITMGWFRQAPGKGLE FVASHSWTDNNPYYADSVKGRFIISRDNSKNRLYLQMNSLRAEDTAVYY CAATARRSFVGRQWYTEARQYDYWGQGTLVTVSS | | |
| AS02640-Durvalumab | 194 | QVQLVESGGGVVQPGRSLRLSCAASGRTITTITMGWFRQAPGKGLEFVAS HSWTDNNPYYADSVKGRFIISRDNSKNRLYLQMNSLRAEDTAVYYCAAT ARRSFVGRQWYTEARQYDYWGQGTLVTVSSEVQLVESGGGLVQPGGSL RLSCAASGFTFSRYWMSWVRQAPGKGLEWVANIKQDGSEKYYVDSVKG RFTISRDNAKNSLYLQMNSLRAEDTAVYYCAREGGWFGELAFDYWGQG TLVTVSSASTKGPSVFPLAPSSKSTSGGTAALGCLVKDYFPEPVTVSWNSG ALTSGVHTFPAVLQSSGLYSLSSVVTVPSSSLGTQTYICNVNHKPSNTKVD KRVEPKSCDKTHTCPPCPAPEFEGGPSVFLFPPKPKDTLMISRTPEVTCVVV DVSHEDPEVKFNWYVDGVEVHNAKTKPREEQYNSTYRVVSVLTVLHQD WLNGKEYKCKVSNKALPASIEKTISKAKGQPREPQVYTLPPSREEMTKNQ VSLTCLVKGFYPSDIAVEWESNGQPENNYKTTPPVLDSDGSFFLYSKLTVD KSRWQQGNVFSCSVMHEALHNHYTQKSLSLSPGK | | |

SEQ ID NO: 195 (Tecentriq® heavy chain amino acid sequence)
EVQLVESGGGLVQPGGSLRLSCAASGFTFSDSWIHWVRQAPGKGLEWVAWISPYGGSTYYADSVKGRFTI
SADTSKNTAYLQMNSLRAEDTAVYYCARRHWPGGFDYWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSNTK
VDKKVEPKSCDKTHTCPPCPAPELLGGPSVFLFPPKPKDTLMISRTPEVTCVVVDVSHEDPEVKFNWYVDG
VEVHNAKTKPREEQYASTYRVVSVLTVLHQDWLNGKEYKCKVSNKALPAPIEKTISKAKGQPREPQVYTL
PPSREEMTKNQVSLTCLVKGFYPSDIAVEWESNGQPENNYKTTPPVLDSDGSFFLYSKLTVDKSRWQQGN
VFSCSVMHEALHNHYTQKSLSLSPGK SEQ ID NO: 197 (Durvalumab heavy chain amino acid sequence)
EVQLVESGGGLVQPGGSLRLSCAASGFTFSRYWMSWVRQAPGKGLEWVANIKQDGSEKYYVDSVKGRFT
ISRDNAKNSLYLQMNSLRAEDTAVYYCAREGGWFGELAFDYWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNHKPS
NTKVDKRVEPKSCDKTHTCPPCPAPEFEGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPASIEKTISKAKGQPREPQV
YTLPPSREEMTKNQVSLTCLVKGFYPSDIAVEWESNGQPENNYKTTPPVLDSDGSFFLYSKLTVDKSRWQQ
GNVFSCSVMHEALHNHYTQKSLSLSPGK SEQ ID NO: 199 (hCTLA-4 full-length amino acid sequence, without signal peptide)
AMHVAQPAVVLASSRGIASFVCEYASPGKATEVRVTVLRQADSQVTEVCAATYMMGNELTFLDDSICTGT
SSGNQVNLTIQGLRAMDTGLYICKVELMYPPPYYLGIGNGTQIYVIDPEPCPDSDFLLWILAAVSSGLFFYSF
LLTAVSLSKMLKKRSPLTTGVYVKMPPTEPECEKQFQPYFIPIN SEQ ID NO: 164 (hCTLA-4 extracellular domain amino acid sequence)
AMHVAQPAVVLASSRGIASFVCEYASPGKATEVRVTVLRQADSQVTEVCAATYMMGNELTFLDDSICTGT
SSGNQVNLTIQGLRAMDTGLYICKVELMYPPPYYLGIGNGTQIYVIDPEPCPDSD SEQ ID NO: 200 (A34311-direct grafted amino acid sequence)
QVQLVESGGGVVQPGRSLRLSCAASGRTITTITMGWVRQAPGKGLEWVASHSWTDNNPYYADSVKGRFTI
SRDNSKNTLYLQMNSLRAEDTAVYYCAKTARRSFVGRQWYTEARQYDYWGQGTLVTVSS SEQ ID NO: 201 (AS02636 humanized sdAb amino acid sequence)
QVQLVESGGGVVQPGRSLRLSCAASGRTITTITMGWFRQAPGKGRQFVASHSWTDNNPYYADSVKGRFIIS
RDNSKNTLYLQMNSLRPEDTAVYYCAATARRSFVGRQWYTEARQYDYWGQGTLVTVSS TABLE 5-continued Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|

SEQ ID NO: 202 (AS02626 humanized sdAb amino acid sequence, consensus amino acid sequence)
QVQLVESGGGVVQPGRSLRLSCAASGRTITTITMGWFRQAPGKGREFVASHSWTDNNPYYADSVKGRFIIS
RDNSKNRLYLQMNSLRAEDTAVYYCAATARRSFVGRQWYTEARQYDYWGQGTLVTVSS SEQ ID NO: 264 (AS02640 sdAb nucleic acid sequence)
CAAGTTCAACTGGTGGAAAGCGGCGGCGGCGTGGTGCAACCGGGTCGTAGCCTGCGTCTGAGCTGCGC
GGCGAGCGGTCGTACCATCACCACCATCACCATGGGTTGGTTCCGTCAGGCGCCGGGCAAGGGTCTTG
AATTTGTGGCGAGCCACAGCTGGACCGACAACAACCCGTACTATGCGGATAGCGTTAAGGGCCGTTTC
ATCATTAGCCGTGACAACAGCAAAAACAGGCTGTACCTGCAGATGAACAGCCTGCGTGCGGAGGATA
CCGCGGTGTACTATTGCGCGGCGACCGCGCGTCGTAGCTTTGTTGGTCGTCAATGGTACACCGAGGCG
CGTCAATACGATTACTGGGGCCAAGGCACCCTGGTTACCGTGAGCAGC SEQ ID NO: 265 (A34311VH11 sdAb nucleic acid sequence)
GAAGTGCAGCTGGTGGAAAGTGGAGGGGGCGTGGTGCAGCCTGGAAGGAAGCCTGAGACTGTCCTGTG
CCGCATCTGGGAGAACTATTACCACAATCACCATGGGATGGTTCCGACAGGCTCCAGGCAAGGGAAG
AGAGTTTGTGGCAAGCCACTCCTGGACAGACAACAATCCTTACTATGCCGATTCTGTCAAGGGCAGGT
TCACAATTTCTCGCGACAACGCCAAAAATACTCTGTACCTGCAGATGAACTCACTGCGACCCGAAGAT
ACTGCCGTGTACTATTGCGCAGCTACCGCTCGACGGAGCTTCGTCGGGAGACAGTGGTACACCGAAGC
AAGACAGTATGATTATTGGGGACAGGGCACTCTGGTCACCGTCAGCAGT SEQ ID NO: 266 (AS07014VH11 sdAb nucleic acid sequence)
GAGGTGCAGCTGGTGGAATCTGGGGGAGGACTGGTGCAGCCTGGGGGAAGCCTGAGACTGAGTTGTG
CCGCAAGCGGATACACTTACAGCAGGCACTGCCTGGGATGGTTCCGACAGGCACCAGGCAAGGGACG
AGAGGCCGTGTCTACCATCGACAGTGATGGGAGCACATCCTGACTCAGTCAAGGGACGGTTTA
CTATCAGCAGATAACGCAAAGAACACCCTGTATCTGCAGATGAACTCCCTGAGACGAAGACAC
AGCCGTGTACTATTGCGCTATCGGACCCAACCCTCGGTACTGTTCTGGCGCCCCAATACCCGGGGAG
CCGAACATTACTTTGGGTATTGGGGACAGGGCACACTGGTGACCGTGAGCAGC SEQ ID NO: 267 (AS07014VH11G54 sdAb nucleic acid sequence)
GAAGTCCAACTGGTCGAATCGGGTGGTGGTCTGGTCCAACCGGGCGGCTCCCTGCGTCTGTCGTGTGC
GGCGTCGGGCTATACCTATTCCCGTCATTGCCTGGGTTGGTTTCGTCAGGCACCGGGCAAAGGTCGTG
AAGCTGTGAGTACCATTGATTCCGGCGGTAGCACGTCTTATGCGGACTCAGTTAAAGGTCGTTTCACC
ATCTCGCGCGATAACGCCAAAAATACGCTGTACCTGCAAATGAACAGCCTGCGCCCGGAAGACACCG
CGGTCTATTACTGCGCCATTGGCCCGAACCCGCGTTATTGTTCTGGTGCGCCGAATACGCGTGGTGCGG
AACATTACTTTGGCTACTGGGGTCAGGGTACGCTGGTTACGGTGTCCTCG SEQ ID NO: 268 (AS07014VH11SGA sdAb nucleic acid sequence)
GAAGTCCAACTGGTCGAAAGTGGTGGTGGCCTGGTCCAACCGGGCGGCTCGCTGCGTCTGTCGTGTGC
TGCGTCTGGCTATACCTACAGCCGTCATTGCCTGGGTTGGTTTCGTCAGGCACCGGGCAAAGGTCGTG
AAGCCGTGTCTACCATTAGCTCTGGCGGTAGTACGCTCCTATGCCAGATTCAGTTAAAGGTCGTTCACCA
TCTCGCGCGACAACGCCAAAAATACGCTGTACCTGCAAATGAACTCCCTGCGCCCGGAAGATACCGCA
GTCTATTACTGCGCTATTGGCCCGAATCCGCGTTATTGTAGCGGTGCGCCGGCCACGCGCGGCGCAGA
ACACTATTTCGGCTACTGGGGTCAGGGCACGCTGGTTACCGTTTCGTCG SEQ ID NO: 269 (AS07014VH11SGQ sdAb nucleic acid sequence)
GAAGTCCAACTGGTCGAAAGCGGCGGCGGCGCC TGGTCCAACCGGGCGGCTCACTGCGTCTGTCCTGTGC
GGCATCGGGCTACACCTATAGCCGTCATTGCCTGGGTTGGTTTCGTCAGGCACCGGGCAAAGGTCGTG
AAGCTGTGTCTACCATTAGCTCTGGCGGTAGTACGTCCTATGCGGATTCAGTTAAAGGTCGTTTCACCA
TCTCGCGCGACAACGCCAAAAATACGCTGTACCTGCAGATGAACTCCCTGCGCCCGGAAGATACCGCG
GTCTATTACTGCGCCATTGGCCCGAATCCGCGTTATTGTAGCGGTGCGCCGAAACGCGTGGTGCGGA
ACATTACTTTGGTTATTGGGTCAGGGTACGCTGGTTACGGTTTCGTCG SEQ ID NO: 270 (AS07014VH11SGS sdAb nucleic acid sequence)
GAAGTCCAACTGGTCGAATCGGGCGGCGGCCTGGTCCAACCGGGTGGCTCACTGCGTCTGTCCTGTGC
GGCAAGCGGCTACACGTATTCCCGTCATTGCCTGGGTTGGTTTCGTCAGGCACCGGGCAAAGGTCGTG
AAGCTGTGAGCACCATTAGCTCTGGCGGTAGTACGTCCTATGCGGATAGCGTTAAAGGTCGTTTCACC
ATCTCTCGCGACAACGCCAAAAATACGCTGTACCTGCAAATGAACAGTCTGCGCCCCGGAAGATACCGC
GGTCTATTACTGCGCCATTGGCCCGAATCCGCGTTATTGTTCAGGTGCGCCGTCGACGCGCGGTGCCGA
ACATTATTTTGGTTACTGGGGTCAGGGTACGCTGGTCACGGTTTCATCA SEQ ID NO: 271 (AS07189TKDVH11 sdAb nucleic acid sequence)
GAGGTGCAGCTGGTGGAAAGCGGGGGGGGCCTGGTGCAGCCTGGAGGAAGCCTGAGACTGAGTTGTG
CCGCAAGTGGCGATAGCCCAAGCGTGAACTACATGGGGTGGTTCAGGCAGGCACCAGGAAAGGGACG
AGAGGAAGTGAGCTCCATCTACCCTACCGGCGGGACATTCTATACTGACTCTGTCAAGGGCCGGTTTA
CCATTAGTAGAGATAACGCCAAAAATACACTGTATCTGCAGATGAACAGCCTGCGACCCGAGGACAC
CGCTGTCTACTATTGCGCTGCTGGGAAATGGGGGACCGACATTGGGGACAGGGGACACTGGTGACCG
TCTCATCA TABLE 5-continued Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|

SEQ ID NO: 272 (AS07189TKDVH11F27 sdAb nucleic acid sequence)
GAAGTGCAACTGGTGGAATCGGGTGGTGGTCTGGTTCAGCCGGGTGGTAGCCTGCGTCTGTCCTGTGC
GGCAAGCGGTTTTTCGCCGAGCGTCAACTATATGGGCTGGTTTCGTCAGGCGCCGGGCAAAGGTCGCG
AAGAAGTGAGCTCTATCTATCCGACCGGCGGCACGTTTTACACCGATAGTGTTAAAGGTCGTTTCACG
ATCTCCCGCGACAACGCGAAAAATACCCTGTACCTGCAAATGAATAGCCTGCGTCCGGAAGATACGGC
CGTTTATTACTGCGCGGCAGGCAAATGGGGCACGGATTACTGGGGTCAGGGCACGCTGGTCACGGTGT
CGTCC SEQ ID NO: 273 (AS07189TKDVH11FY sdAb nucleic acid sequence)
GAAGTGCAGCTGGTGGAAAGCGGAGGAGGACTGGTGCAGCCTGGCGGAAGCCTGAGACTGAGTTGTG
CCGCATCTGGGTTTAGCCCCAGCGTGAACTACATGGGGTGGTTCAGGCAGGCACCAGGAAAGGGACG
AGAGGAAGTGAGCTCCATCTACCCTACCGGCGGGACATTCTATACTGACTCTGTCAAGGGCCGGTTTA
CCATTAGTAGAGATAACGCCAAAAATACACTGTATCTGCAGATGAACAGCCTGCGACCCGAGGACAC
CGCTGTCTACTATTGCGCAGCAGGGAAATACGGAACCGATTACTGGGGGCAGGGAACTCTGGTCACTG
TCAGCAGC SEQ ID NO: 274 (A34311VH11 humanized sdAb amino acid sequence; CDRs are underlined)
EVQLVESGGGVVQPGRSLRLSCAAS<u>GRTITTITMG</u>WFRQAPGKGREFVA<u>SHSWTDNNPYYADSVKG</u>RFTIS
RDNAKNTLYLQMNSLRPEDTAVYYCAA<u>TARRSFVGRQWYTEARQYDYW</u>GQGTLVTVSS SEQ ID NO: 275 (AS07014VH11 humanized sdAb amino acid sequence; CDRs are underlined)
EVQLVESGGGLVQPGGSLRLSCAAS<u>GYTYSRHCLG</u>WFRQAPGKGREAVS<u>TIDSDGSTSYADSVKG</u>RFTISR
DNAKNTLYLQMNSLRPEDTAVYYCAI<u>GPNPRYCSGAPNTRGAEHYFGYW</u>GQGTLVTVSS SEQ ID NO: 276 (AS07014VH11G54 humanized sdAb amino acid sequence; CDRs are underlined)
EVQLVESGGGLVQPGGSLRLSCAAS<u>GYTYSRHCLG</u>WFRQAPGKGREAVS<u>TIDSGGSTSYADSVKG</u>RFTISR
DNAKNTLYLQMNSLRPEDTAVYYCAI<u>GPNPRYCSGAPNTRGAEHYFGYW</u>GQGTLVTVSS SEQ ID NO: 277 (AS07014VH11SGA humanized sdAb amino acid sequence; CDRs are underlined)
EVQLVESGGGLVQPGGSLRLSCAAS<u>GYTYSRHCLG</u>WFRQAPGKGREAVS<u>TISSGGSTSYADSVKG</u>RFTISR
DNAKNTLYLQMNSLRPEDTAVYYCAI<u>GPNPRYCSGAPATRGAEHYFGYW</u>GQGTLVTVSS SEQ ID NO: 278 (AS07014VH11SGQ humanized sdAb amino acid sequence; CDRs are underlined)
EVQLVESGGGLVQPGGSLRLSCAAS<u>GYTYSRHCLG</u>WFRQAPGKGREAVS<u>TISSGGSTSYADSVKG</u>RFTISR
DNAKNTLYLQMNSLRPEDTAVYYCAI<u>GPNPRYCSGAPQTRGAEHYFGYW</u>GQGTLVTVSS SEQ ID NO: 279 (AS07014VH11SGS humanized sdAb amino acid sequence; CDRs are underlined)
EVQLVESGGGLVQPGGSLRLSCAAS<u>GYTYSRHCLG</u>WFRQAPGKGREAVS<u>TISSGGSTSYADSVKG</u>RFTISR
DNAKNTLYLQMNSLRPEDTAVYYCAI<u>GPNPRYCSGAPSTRGAEHYFGYW</u>GQGTLVTVSS SEQ ID NO: 280 (AS07189TKDVH11 humanized sdAb amino acid sequence; CDRs are underlined)
EVQLVESGGGLVQPGGSLRLSCAAS<u>GDSPSVNYMG</u>WFRQAPGKGREEVS<u>SIYPTGGTFYTDSVKG</u>RFTISR
DNAKNTLYLQMNSLRPEDTAVYYCAA<u>GKWGTDYW</u>GQGTLVTVSS SEQ ID NO: 281 (AS07189TKDVH11F27 humanized sdAb amino acid sequence; CDRs are underlined)
EVQLVESGGGLVQPGGSLRLSCAAS<u>GFSPSVNYMG</u>WFRQAPGKGREEVS<u>SIYPTGGTFYTDSVKG</u>RFTISR
DNAKNTLYLQMNSLRPEDTAVYYCAA<u>GKWGTDYW</u>GQGTLVTVSS SEQ ID NO: 282 (AS07189TKDVH11FY humanized sdAb amino acid sequence; CDRs are underlined)
EVQLVESGGGLVQPGGSLRLSCAAS<u>GFSPSVNYMG</u>WFRQAPGKGREEVS<u>SIYPTGGTFYTDSVKG</u>RFTISR
DNAKNTLYLQMNSLRPEDTAVYYCAA<u>GKYGTDYW</u>GQGTLVTVSS SEQ ID NO: 283 (A34311VH11 HCAb dimeric form amino acid sequence)
EVQLVESGGGVVQPGRSLRLSCAASGRTITTITMGWFRQAPGKGREFVASHSWTDNNPYYADSVKGRFTIS
RDNAKNTLYLQMNSLRPEDTAVYYCAATARRSFVGRQWYTEARQYDYWGQGTLVTVSSEPKSCDKTHTC
PPCPAPELLGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEKTISKAKGQPREPQVYTLPPSRDELTKNQVSLTC
LVKGFYPSDIAVEWESNGQPENNYKTTPPVLDSDGSFFLYSKLTVDKSRWQQGNVFSCSVMHEALHNHYT
QKSLSLSPGK SEQ ID NO: 284 (AS07014VH11 HCAb dimeric form amino acid sequence)
EVQLVESGGGLVQPGGSLRLSCAASGYTYSRHCLGWFRQAPGKGREAVSTIDSDGSTSYADSVKGRFTISR
DNAKNTLYLQMNSLRPEDTAVYYCAIGPNPRYCSGAPNTRGAEHYFGYWGQGTLVTVSSEPKSCDKTHTC
PPCPAPELLGGPSVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVYTLPPSRDELTKNQVSLTCL
VKGFYPSDIAVEWESNGQPENNYKTTPPVLDSDGSFFLYSKLTVDKSRWQQGNVFSCSVMHEALHNHYTQ
KSLSLSPGK SEQ ID NO: 285 (AS07014VH11G54 HCAb dimeric form amino acid sequence)
EVQLVESGGGLVQPGGSLRLSCAASGYTYSRHCLGWFRQAPGKGREAVSTIDSGGSTSYADSVKGRFTISR
DNAKNTLYLQMNSLRPEDTAVYYCAIGPNPRYCSGAPNTRGAEHYFGYWGQGTLVTVSSEPKSCDKTHTC

TABLE 5-continued

Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|

PPCPAPELLGGPSVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVYTLPPSRDELTKNQVSLTCL
VKGFYPSDIAVEWESNGQPENNYKTTPPVLDSDGSFFLYSKLTVDKSRWQQGNVFSCSVMHEALHNHYTQ
KSLSLSPGK

SEQ ID NO: 286 (AS07014VH11SGA HCAb dimeric form amino acid sequence)
EVQLVESGGGLVQPGGSLRLSCAASGYTYSRHCLGWFRQAPGKGREAVSTISSGGSTSYADSVKGRFTISR
DNAKNTLYLQMNSLRPEDTAVYYCAIGPNPRYCSGAPATRGAEHYFGYWGQGTLVTVSSEPKSCDKTHTC
PPCPAPELLGGPSVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVYTLPPSRDELTKNQVSLTCL
VKGFYPSDIAVEWESNGQPENNYKTTPPVLDSDGSFFLYSKLTVDKSRWQQGNVFSCSVMHEALHNHYTQ
KSLSLSPGK SEQ ID NO: 287 (AS07014VH11SGQ HCAb dimeric form amino acid sequence)
EVQLVESGGGLVQPGGSLRLSCAASGYTYSRHCLGWFRQAPGKGREAVSTISSGGSTSYADSVKGRFTISR
DNAKNTLYLQMNSLRPEDTAVYYCAIGPNPRYCSGAPQTRGAEHYFGYWGQGTLVTVSSEPKSCDKTHTC
PPCPAPELLGGPSVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVYTLPPSRDELTKNQVSLTCL
VKGFYPSDIAVEWESNGQPENNYKTTPPVLDSDGSFFLYSKLTVDKSRWQQGNVFSCSVMHEALHNHYTQ
KSLSLSPGK SEQ ID NO: 288 (AS07014VH11SGS HCAb dimeric form amino acid sequence)
EVQLVESGGGLVQPGGSLRLSCAASGYTYSRHCLGWFRQAPGKGREAVSTISSGGSTSYADSVKGRFTISR
DNAKNTLYLQMNSLRPEDTAVYYCAIGPNPRYCSGAPSTRGAEHYFGYWGQGTLVTVSSEPKSCDKTHTC
PPCPAPELLGGPSVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVYTLPPSRDELTKNQVSLTCL
VKGFYPSDIAVEWESNGQPENNYKTTPPVLDSDGSFFLYSKLTVDKSRWQQGNVFSCSVMHEALHNHYTQ
KSLSLSPGK SEQ ID NO: 289 (AS07189TKDVH11 HCAb dimeric form amino acid sequence)
EVQLVESGGGLVQPGGSLRLSCAASGDSPSVNYMGWFRQAPGKGREEVSSIYPTGGTFYTDSVKGRFTISR
DNAKNTLYLQMNSLRPEDTAVYYCAAGKWGTDYWGQGTLVTVSSEPKSCDKTHTCPPCPAPELLGGPSV
FLFPPKPKDTLMISRTPEVTCVVVDVSHEDPEVKFNWYVDGVEVHNAKTKPREEQYNSTYRVVSVLTVLH
QDWLNGKEYKCKVSNKALPAPIEKTISKAKGQPREPQVYTLPPSRDELTKNQVSLTCLVKGFYPSDIAVEW
ESNGQPENNYKTTPPVLDSDGSFFLYSKLTVDKSRWQQGNVFSCSVMHEALHNHYTQKSLSLSPGK SEQ ID NO: 290 (AS07189TKDVH11F27 HCAb dimeric form amino acid sequence)
EVQLVESGGGLVQPGGSLRLSCAASGFSPSVNYMGWFRQAPGKGREEVSSIYPTGGTFYTDSVKGRFTISR
DNAKNTLYLQMNSLRPEDTAVYYCAAGKWGTDYWGQGTLVTVSSEPKSCDKTHTCPPCPAPELLGGPSV
FLFPPKPKDTLMISRTPEVTCVVVDVSHEDPEVKFNWYVDGVEVHNAKTKPREEQYNSTYRVVSVLTVLH
QDWLNGKEYKCKVSNKALPAPIEKTISKAKGQPREPQVYTLPPSRDELTKNQVSLTCLVKGFYPSDIAVEW
ESNGQPENNYKTTPPVLDSDGSFFLYSKLTVDKSRWQQGNVFSCSVMHEALHNHYTQKSLSLSPGK SEQ ID NO: 291 (AS07189TKDVH11FY HCAb dimeric form amino acid sequence)
EVQLVESGGGLVQPGGSLRLSCAASGFSPSVNYMGWFRQAPGKGREEVSSIYPTGGTFYTDSVKGRFTISR
DNAKNTLYLQMNSLRPEDTAVYYCAAGKYGTDYWGQGTLVTVSSEPKSCDKTHTCPPCPAPELLGGPSVF
LFPPKPKDTLMISRTPEVTCVVVDVSHEDPEVKFNWYVDGVEVHNAKTKPREEQYNSTYRVVSVLTVLHQ
DWLNGKEYKCKVSNKALPAPIEKTISKAKGQPREPQVYTLPPSRDELTKNQVSLTCLVKGFYPSDIAVEWE
SNGQPENNYKTTPPVLDSDGSFFLYSKLTVDKSRWQQGNVFSCSVMHEALHNHYTQKSLSLSPGK

TABLE 7

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-73 (A34311 VH11-mutated hIgG1 hinge-Keytruda) | 292 | EVQLVESGGGVVQPGRSLRLSCAASGRTITTITMGWFRQAPGKGREFVAS HSWTDNNPYYADSVKGRFTISRDNAKNTLYLQMNSLRPEDTAVYYCAAT ARRSFVGRQWYTEARQYDYWGQGTLVTVSS<u>EPKSSDKTHTSPPSPVQL</u> VQSGVEVKKPGASVKVSCKASGYTFTNYYMYWVRQAPGQGLEWMGGI NPSNGGTNFNEKFKNRVTLTTDSSTTTAYMELKSLQFDDTAVYYCARRD YRFDMGFDYWGQGTTVTVSSASTKGPSVFPLAPCSRSTSESTAALGCLVK DYFPEPVTVSWNSGALTSGVHTFPAVLQSSGLYSLSSVVTVPSSSLGTKTY TCNVDHKPSNTKVDKRVESKYGPPCPPCPAPEFLGGPSVFLFPPKPKDTLM ISRTPEVTCVVVDVSQEDPEVQFNWYVDGVEVHNAKTKPREEQFNSTYR VVSVLTVLHQDWLNGKEYKCKVSNKGLPSSIEKTISKAKGQPREPQVYTL PPSQEEMTKNQVSLTCLVKGFYPSDIAVEWESNGQPENNYKTTPPVLDSD GSFFLYSRLTVDKSRWQEGNVFSCSVMHEALHNHYTQKSLSLSLGK | 159 | EIVLTQSP ATLSLSP GERATLS CRASKGV STSGYSY LHWYQQ KPGQAPR LLIYLAS YLESGVP ARFSGSG SGTDFTL TISSLEPE |

TABLE 7-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-74 (AS0701 4VH11-mutated hIgG1 hinge-Keytruda) | 293 | EVQLVESGGGLVQPGGSLRLSCAASGYTYSRHCLGWFRQAPGKGREAVS TIDSDGSTSYADSVKGRFTISRDNAKNTLYLQMNSLRPEDTAVYYCAIGPN PRYCSGAPNTRGAEHYFGYWGQGTLVTVSS<u>EPKSSDKTHTSPPSP</u>QVQL QSGVEVKKPGASVKVSCKASGYTFTNYYMYWVRQAPGQGLEWMGGINP SNGGTNFNEKFKNRVTLTTDSSTTTAYMELKSLQFDDTAVYYCARRDYR FDMGFDYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK | | DFAVYYC QHSRDLP LTFGGGT KVEIKRT VAAPSVF IFPPSDEQ LKSGTAS VVCLLNN FYPREAK VQWKVD NALQSGN SQESVTE |
| BCP-75 (AS0718 9TKDV H11-mutated hIgG1 hinge-Keytruda) | 294 | EVQLVESGGGLVQPGGSLRLSCAASGDSPSVNYMGWFRQAPGKGREEVS SIYPTGGTFYTDSVKGRFTISRDNAKNTLYLQMNSLRPEDTAVYYCAAGK WGTDYWGQGTLVTVSS<u>EPKSSDKTHTSPPSP</u>QVQLVQSGVEVKKPGASV KVSCKASGYTFTNYYMYWVRQAPGQGLEWMGGINPSNGGTNFNEKFKN RVTLTTDSSTTTAYMELKSLQFDDTAVYYCARRDYRFDMGFDYWGQGT TVTVSSASTKGPSVFPLAPCSRSTSESTAALGCLVKDYFPEPVTVSWNSGA LTSGVHTFPAVLQSSGLYSLSSVVTVPSSSLGTKTYTCNVDHKPSNTKVDK RVESKYGPPCPPCPAPEFLGGPSVFLFPPKPKDTLMISRTPEVTCVVVDVSQ EDPEVQFNWYVDGVEVHNAKTKPREEQFNSTYRVVSVLTVLHQDWLNG KEYKCKVSNKGLPSSIEKTISKAKGQPREPQVYTLPPSQEEMTKNQVSLTC LVKGFYPSDIAVEWESNGQPENNYKTTPPVLDSDGSFFLYSRLTVDKSRW QEGNVFSCSVMHEALHNHYTQKSLSLSLGK | | QDSKDST YSLSSTLT LSKADYE KHKVYA CEVTHQG LSSPVTK SFNRGEC |
| BCP-90 (AS0701 4VH11S GQ-mutated hIgG1 hinge-Keytruda) | 295 | EVQLVESGGGLVQPGGSLRLSCAASGYTYSRHCLGWFRQAPGKGREAVS TISSGGSTSYADSVKGRFTISRDNAKNTLYLQMNSLRPEDTAVYYCAIGPN PRYCSGAPQTRGAEHYFGYWGQGTLVTVSS<u>EPKSSDKTHTSPPSP</u>QVQLV QSGVEVKKPGASVKVSCKASGYTFTNYYMYWVRQAPGQGLEWMGGINP SNGGTNFNEKFKNRVTLTTDSSTTTAYMELKSLQFDDTAVYYCARRDYR FDMGFDYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK | | |
| BCP-91 (AS0718 9TKDV H11FY-mutated hIgG1 hinge-Keytruda) | 296 | EVQLVESGGGLVQPGGSLRLSCAASGFSPSVNYMGWFRQAPGKGREEVS SIYPTGGTFYTDSVKGRFTISRDNAKNTLYLQMNSLRPEDTAVYYCAAGK YGTDYWGQGTLVTVSS<u>EPKSSDKTHTSPPSP</u>QVQLVQSGVEVKKPGASV KVSCKASGYTFTNYYMYWVRQAPGQGLEWMGGINPSNGGTNFNEKFKN RVTLTTDSSTTTAYMELKSLQFDDTAVYYCARRDYRFDMGFDYWGQGT TVTVSSASTKGPSVFPLAPCSRSTSESTAALGCLVKDYFPEPVTVSWNSGA LTSGVHTFPAVLQSSGLYSLSSVVTVPSSSLGTKTYTCNVDHKPSNTKVDK RVESKYGPPCPPCPAPEFLGGPSVFLFPPKPKDTLMISRTPEVTCVVVDVSQ EDPEVQFNWYVDGVEVHNAKTKPREEQFNSTYRVVSVLTVLHQDWLNG KEYKCKVSNKGLPSSIEKTISKAKGQPREPQVYTLPPSQEEMTKNQVSLTC LVKGFYPSDIAVEWESNGQPENNYKTTPPVLDSDGSFFLYSRLTVDKSRW QEGNVFSCSVMHEALHNHYTQKSLSLSLGK | | |
| BCP-78 (A34311 VH11-mutated hIgG1 hinge-Opdivo) | 297 | EVQLVESGGGVVQPGRSLRLSCAASGRTITTITMGWFRQAPGKGREFVAS HSWTDNNPYYADSVKGRFTISRDNAKNTLYLQMNSLRPEDTAVYYCAAT ARRSFVGRQWYTEARQYDYWGQGTLVTVSS<u>EPKSSDKTHTSPPSP</u>QVQL VESGGGVVQPGRSLRLDCKASGITFSNSGMHWVRQAPGKGLEWVAVIW YDGSKRYYADSVKGRFTISRDNSKNTLFLQMNSLRAEDTAVYYCATNDD YWGQGTLVTVSSASTKGPSVFPLAPCSRSTSESTAALGCLVKDYFPEPVTV SWNSGALTSGVHTFPAVLQSSGLYSLSSVVTVPSSSLGTKTYTCNVDHKPS NTKVDKRVESKYGPPCPPCPAPEFLGGPSVFLFPPKPKDTLMISRTPEVTCV VVDVSQEDPEVQFNWYVDGVEVHNAKTKPREEQFNSTYRVVSVLTVLH QDWLNGKEYKCKVSNKGLPSSIEKTISKAKGQPREPQVYTLPPSQEEMTK NQVSLTCLVKGFYPSDIAVEWESNGQPENNYKTTPPVLDSDGSFFLYSRL VDKSRWQEGNVFSCSVMHEALHNHYTQKSLSLSLGK | 161 | EIVLTQSP ATLSLSP GERATLS CRASQSV SSYLAWY QQKPGQ APRLLIY DASNRAT GIPARFSG SGSGTDF TLTISSLE PEDFAVY YCQQSSN WPRTFGQ GTKVEIK RTVAAPS VFIFPPSD EQLKSGT ASVVCLL NNFYPRE AKVQWK VDNALQS GNSQESV TEQDSKD |
| BCP-79 (AS0701 4VH11-mutated hIgG1 hinge-Opdivo) | 298 | EVQLVESGGGLVQPGGSLRLSCAASGYTYSRHCLGWFRQAPGKGREAVS TIDSDGSTSYADSVKGRFTISRDNAKNTLYLQMNSLRPEDTAVYYCAIGPN PRYCSGAPNTRGAEHYFGYWGQGTLVTVSS<u>EPKSSDKTHTSPPSP</u>QVQLV ESGGGVVQPGRSLRLDCKASGITFSNSGMHWVRQAPGKGLEWVAVIWY DGSKRYYADSVKGRFTISRDNSKNTLFLQMNSLRAEDTAVYYCATNDDY WGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPS NTKVDKRVESKYGPPCPPCPAPEFLGGPSVFLFPPKPKDTLMISRTPEVTCV VVDVSQEDPEVQFNWYVDGVEVHNAKTKPREEQFNSTYRVVSVLTVLH QDWLNGKEYKCKVSNKGLPSSIEKTISKAKGQPREPQVYTLPPSQEEMTK NQVSLTCLVKGFYPSDIAVEWESNGQPENNYKTTPPVLDSDGSFFLYSRLT VDKSRWQEGNVFSCSVMHEALHNHYTQKSLSLSLGK | | |

TABLE 7-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-80 (AS0718 9TKDV H11-mutated hIgG1 hinge-Opdivo) | 299 | EVQLVESGGGLVQPGGSLRLSCAASGDSPSVNYMGWFRQAPGKGREEVS SIYPTGGTFYTDSVKGRFTISRDNSKNTLYLQMNSLRPEDTAVYYCAAGK WGTDYWGQGTLVTVSS<u>EPKSSDKTHTSPPSP</u>QVQLVESGGGVVQPGRSL RLDCKASGITFSNSGMHWVRQAPGKGLEWVAVIWYDGSKRYYADSVKG RFTISRDNSKNTLFLQMNSLRAEDTAVYYCATNDDYWGQGTLVTVSSAS TKGPSVFPLAPCSRSTSESTAALGCLVKDYFPEPVTVSWNSGALTSGVHTF PAVLQSSGLYSLSSVVTVPSSSLGTKTYTCNVDHKPSNTKVDKRVESKYG PPCPPCPAPEFLGGPSVFLFPPKPKDTLMISRTPEVTCVVVDVSQEDPEVQF NWYVDGVEVHNAKTKPREEQFNSTYRVVSVLTVLHQDWLNGKEYKCK VSNKGLPSSIEKTISKAKGQPREPQVYTLPPSQEEMTKNQVSLTCLVKGFY PSDIAVEWESNGQPENNYKTTPPVLDSDGSFFLYSRLTVDKSRWQEGNVF SCSVMHEALHNHYTQKSLSLSLGK | | STYSLSST LTLSKAD YEKHKV YACEVTH QGLSSPV TKSFNRG EC |
| BCP-94 (AS0701 4VH11S GQ-mutated hIgG1 hinge-Opdivo) | 300 | EVQLVESGGGLVQPGGSLRLSCAASGYTYSRHCLGWFRQAPGKGREAVS TISSGGSTSYADSVKGRFTISRDNAKNTLYLQMNSLRPEDTAVYYCAIGPN PRYCSGAPQTRGAEHYFGYWGQGTLVTVSS<u>EPKSSDKTHTSPPSP</u>QVLV ESGGGVVQPGRSLRLDCKASGITFSNSGMHWVRQAPGKGLEWVAVIWY DGSKRYYADSVKGRFTISRDNSKNTLFLQMNSLRAEDTAVYYCATNDDY WGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPS NTKVDKRVESKYGPPCPPCPAPEFLGGPSVFLFPPKPKDTLMISRTPEVTCV VVDVSQEDPEVQFNWYVDGVEVHNAKTKPREEQFNSTYRVVSVLTVLH QDWLNGKEYKCKVSNKGLPSSIEKTISKAKGQPREPQVYTLPPSQEEMTK NQVSLTCLVKGFYPSDIAVEWESNGQPENNYKTTPPVLDSDGSFFLYSRLT VDKSRWQEGNVFSCSVMHEALHNHYTQKSLSLSLGK | | |
| BCP-95 (AS0718 9TKDV H11FY-mutated hIgG1 hinge-Opdivo) | 301 | EVQLVESGGGLVQPGGSLRLSCAASGFSPSVNYMGWFRQAPGKGREEVS SIYPTGGTFYTDSVKGRFTISRDNSKNTLYLQMNSLRPEDTAVYYCAAGK YGTDYWGQGTLVTVSS<u>EPKSSDKTHTSPPSP</u>QVQLVESGGGVVQPGRSLR LDCKASGITFSNSGMHWVRQAPGKGLEWVAVIWYDGSKRYYADSVKGR FTISRDNSKNTLFLQMNSLRAEDTAVYYCATNDDYWGQGTLVTVSSAST KGPSVFPLAPCSRSTSESTAALGCLVKDYFPEPVTVSWNSGALTSGVHTFP AVLQSSGLYSLSSVVTVPSSSLGTKTYTCNVDHKPSNTKVDKRVESKYGP PCPPCPAPEFLGGPSVFLFPPKPKDTLMISRTPEVTCVVVDVSQEDPEVQFN WYVDGVEVHNAKTKPREEQFNSTYRVVSVLTVLHQDWLNGKEYKCKVS NKGLPSSIEKTISKAKGQPREPQVYTLPPSQEEMTKNQVSLTCLVKGFYPS DIAVEWESNGQPENNYKTTPPVLDSDGSFFLYSRLTVDKSRWQEGNVFSC SVMHEALHNHYTQKSLSLSLGK | | |
| BCP-100 (AS0718 9TKDV H11FY-mutated hIgG1 hinge-PD1BM min) | 310 | EVQLVESGGGLVQPGGSLRLSCAASGFSPSVNYMGWFRQAPGKGREEVS SIYPTGGTFYTDSVKGRFTISRDNSKNTLYLQMNSLRPEDTAVYYCAAGK YGTDYWGQGTLVTVSS<u>EPKSSDKTHTSPPSP</u>EVQLVESGGGLVQPGGSLR LSCAASGFVFSRYDMAWVRQAPGKGLEWVSFISGGGSNTYYPDTVKGRF TISRDNSKNTLYLQMNSLRAEDTAVYYCISPYYYAMEYWGQGTTVTVSS ASTKGPSVFPLAPCSRSTSESTAALGCLVKDYFPEPVTVSWNSGALTSGVH TFPAVLQSSGLYSLSSVVTVPSSSLGTKTYTCNVDHKPSNTKVDKRVESK YGPPCPPCPAPEFLGGPSVFLFPPKPKDTLMISRTPEVTCVVVDVSQEDPEV QFNWYVDGVEVHNAKTKPREEQFNSTYRVVSVLTVLHQDWLNGKEYKC KVSNKGLPSSIEKTISKAKGQPREPQVYTLPPSQEEMTKNQVSLTCLVKGF YPSDIAVEWESNGQPENNYKTTPPVLDSDGSFFLYSRLTVDKSRWQEGNV FSCSVMHEALHNHYTQKSLSLSLGK | 309 | DIQMTQS PSSVSAS VGDRVTI TCKASQD VDTAVA WYQQKP GKAPKLL IYWASTR HTGVPSR FSGSGSG TDFTLTIS SLQPEDF ATYYCQ QYSTFPW TFGGGTK VEIKRTV AAPSVFIF PPSDEQL KSGTASV VCLLNNF YPREAKV QWKVDN ALQSGNS QESVTEQ DSKDSTY SLSSTLTL SKADYEK IIKVYAC EVTHQGL SSPVTKSF NRGEC |
| BCP-101 (AS0701 4VH11S GQ-mutated hIgG1 hinge-PD1BM min) | 311 | EVQLVESGGGLVQPGGSLRLSCAASGYTYSRHCLGWFRQAPGKGREAVS TISSGGSTSYADSVKGRFTISRDNAKNTLYLQMNSLRPEDTAVYYCAIGPN PRYCSGAPQTRGAEHYFGYWGQGTLVTVSS<u>EPKSSDKTHTSPPSP</u>EVQLV ESGGGLVQPGGSLRLSCAASGFVFSRYDMAWVRQAPGKGLEWVSFISGG GSNTYYPDTVKGRFTISRDNSKNTLYLQMNSLRAEDTAVYYCISPYYYAM EYWGQGTTVTVSSASTKGPSVFPLAPCSRSTSESTAALGCLVKDYFPEPVT VSWNSGALTSGVHTFPAVLQSSGLYSLSSVVTVPSSSLGTKTYTCNVDHK PSNTKVDKRVESKYGPPCPPCPAPEFLGGPSVFLFPPKPKDTLMISRTPEVT CVVVDVSQEDPEVQFNWYVDGVEVHNAKTKPREEQFNSTYRVVSVLTV LHQDWLNGKEYKCKVSNKGLPSSIEKTISKAKGQPREPQVYTLPPSQEEM TKNQVSLTCLVKGFYPSDIAVEWESNGQPENNYKTTPPVLDSDGSFFLYS RLTVDKSRWQEGNVFSCSVMHEALHNHYTQKSLSLSLGK | | |
| BCP-103 (AS0718 9TKDV H21FY-mutated hIgG1 hinge-PD1BM min) | 312 | EVQLVESGGGLVQPGGSLRLSCAASGFSPSVNYMGWVRQAPGKGLEEVS SIYPTGGTFYTDSVKGRFTISRDNSKNTLYLQMNSLRAEDTAVYYCAAGK YGTDYWGQGTLVTVSS<u>EPKSSDKTHTSPPSP</u>EVQLVESGGGLVQPGGSLR LSCAASGFVFSRYDMAWVRQAPGKGLEWVSFISGGGSNTYYPDTVKGRF TISRDNSKNTLYLQMNSLRAEDTAVYYCISPYYYAMEYWGQGTTVTVSS ASTKGPSVFPLAPCSRSTSESTAALGCLVKDYFPEPVTVSWNSGALTSGVH TFPAVLQSSGLYSLSSVVTVPSSSLGTKTYTCNVDHKPSNTKVDKRVESK YGPPCPPCPAPEFLGGPSVFLFPPKPKDTLMISRTPEVTCVVVDVSQEDPEV QFNWYVDGVEVHNAKTKPREEQFNSTYRVVSVLTVLHQDWLNGKEYKC KVSNKGLPSSIEKTISKAKGQPREPQVYTLPPSQEEMTKNQVSLTCLVKGF YPSDIAVEWESNGQPENNYKTTPPVLDSDGSFFLYSRLTVDKSRWQEGNV FSCSVMHEALHNHYTQKSLSLSLGK | | |

TABLE 7-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-104 (A34311 VH2-mutated hIgG1 hinge-PD1BM min) | 313 | EVQLVESGGGVVQPGRSLRLSCAASGRTITTITMGWFRQAPGKGLEFVAS HSWTDNNPYYADSVKGRFTISRDNKNTLYLQMNSLRAEDTAVYYCAAT ARRSFVGRQWYTEARQYDYWGQGTLVTVSS<u>EPKSSDKTHTSPPSP</u>EVQL VESGGGLVQPGGSLRLSCAASGFVFSRYDMAWVRQAPGKGLEWVSFISG GGSNTYYPDTVKGRFTISRDNSKNTLYLQMNSLRAEDTAVYYCISPYYYA MEYWGQGTTVTVSSASTKGPSVFPLAPCSRSTSESTAALGCLVKDYFPEP VTVSWNSGALTSGVHTFPAVLQSSGLYSLSSVVTVPSSSLGTKTYTCNVD HKPSNTKVDKRVESKYGPPCPPCPAPEFLGGPSVFLFPPKPKDTLMISRTPE VTCVVVDVSQEDPEVQFNWYVDGVEVHNAKTKPREEQFNSTYRVVSVL TVLHQDWLNGKEYKCKVSNKGLPSSIEKTISKAKGQPREPQVYTLPPSQE EMTKNQVSLTCLVKGFYPSDIAVEWESNGQPENNYKTTPPVLDSDGSFFL YSRLTVDKSRWQEGNVFSCSVNHEALHNHYTQKSLSLSLGK | | |
| BCP-105 (A34311 VH2F53-mutated hIgG1 hinge-PD1BM min) | 314 | EVQLVESGGGVVQPGRSLRLSCAASGRTITTITMGWFRQAPGKGLEFVAS HSFTDNNPYYADSVKGRFTISRDNSKNTLYLQMNSLRAEDTAVYYCAAT ARRSFVGRQWYTEARQYDYWGQGTLVTVSS<u>EPKSSDKTHTSPPSP</u>EVQL VESGGGLVQPGGSLRLSCAASGFVFSRYDMAWVRQAPGKGLEWVSFISG GGSNTYYPDTVKGRFTISRDNSKNTLYLQMNSLRAEDTAVYYCISPYYYA MEYWGQGTTVTVSSASTKGPSVFPLAPCSRSTSESTAALGCLVKDYFPEP VTVSWNSGALTSGVHTFPAVLQSSGLYSLSSVVTVPSSSLGTKTYTCNVD HKPSNTKVDKRVESKYGPPCPPCPAPEFLGGPSVFLFPPKPKDTLMISRTPE VTCVVVDVSQEDPEVQFNWYVDGVEVHNAKTKPREEQFNSTYRVVSVL TVLHQDWLNGKEYKCKVSNKGLPSSIEKTISKAKGQPREPQVYTLPPSQE EMTKNQVSLTCLVKGFYPSDIAVEWESNGQPENNYKTTPPVLDSDGSFFL YSRLTVDKSRWQEGNVFSCSVMHEALHNHYTQKSLSLSLGK | | |
| BCP-106 (A34311 VH11-mutated hIgG1 hinge-PD1BM min) | 315 | EVQLVESGGGVVQPGRSLRLSCAASGRTITTITMGWFRQAPGKREFVAS HSWTDNNPYYADSVKGRFTISRDNAKNTLYLQMNSLRPEDTAVYYCAAT ARRSFVGRQWYTEARQYDYWGQGTLVTVSS<u>EPKSSDKTHTSPPSP</u>EVQL VESGGGLVQPGGSLRLSCAASGFVFSRYDMAWVRQAPGKGLEWVSFISG GGSNTYYPDTVKGRFTISRDNSKNTLYLQMNSLRAEDTAVYYCISPYYYA MEYWGQGTTVTVSSASTKGPSVFPLAPCSRSTSESTAALGCLVKDYFPEP VTVSWNSGALTSGVHTFPAVLQSSGLYSLSSVVTVPSSSLGTKTYTCNVD HKPSNTKVDKRVESKYGPPCPPCPAPEFLGGPSVFLFPPKPKDTLMISRTPE VTCVVVDVSQEDPEVQFNWYVDGVEVHNAKTKPREEQFNSTYRVVSVL TVLHQDWLNGKEYKCKVSNKGLPSSIEKTISKAKGQPREPQVYTLPPSQE EMTKNQVSLTCLVKGFYPSDIAVEWESNGQPENNYKTTPPVLDSDGSFFL YSRLTVDKSRWQEGNVFSCSVMHEALHNHYTQKSLSLSLGK | | |
| BCP-107 (A34311 VH11F53-mutated hIgG1 hinge-PD1BM min) | 316 | EVQLVESGGGVVQPGRSLRLSCAASGRTITTITMGWFRQAPGKREFVAS HSFTDNNPYYADSVKGRFTISRDNAKNTLYLQMNSLRPEDTAVYYCAAT ARRSFVGRQWYTEARQYDYWGQGTLVTVSS<u>EPKSSDKTHTSPPSP</u>EVQL VESGGGLVQPGGSLRLSCAASGFVFSRYDMAWVRQAPGKGLEWVSFISG GGSNTYYPDTVKGRFTISRDNSKNTLYLQMNSLRAEDTAVYYCISPYYYA MEYWGQGTTVTVSSASTKGPSVFPLAPCSRSTSESTAALGCLVKDYFPEP VTVSWNSGALTSGVHTFPAVLQSSGLYSLSSVVTVPSSSLGTKTYTCNVD HKPSNTKVDKRVESKYGPPCPPCPAPEFLGGPSVFLFPPKPKDTLMISRTPE VTCVVVDVSQEDPEVQFNWYVDGVEVHNAKTKPREEQFNSTYRVVSVL TVLHQDWLNGKEYKCKVSNKGLPSSIEKTISKAKGQPREPQVYTLPPSQE EMTKNQVSLTCLVKGFYPSDIAVEWESNGQPENNYKTTPPVLDSDGSFFL YSRLTVDKSRWQEGNVFSCSVMHEALHNHYTQKSLSLSLGK | | |
| BCP-108 (AS0701 4VH11-mutated hIgG1 hinge-PD1BM min) | 317 | EVQLVESGGGLVQPGGSLRLSCAASGYTYSRHCLGWFRQAPGKREAVS TIDSDGSTSYADSVKGRFTISRDNAKNTLYLQMNSLRPEDTAVYYCAIGPN PRYCSGAPNTRGAEHYFGYWGQGTLVTVSS<u>EPKSSDKTHTSPPSP</u>EVQLV ESGGGLVQPGGSLRLSCAASGFVFSRYDMAWVRQAPGKGLEWVSFISGG GSNTYYPDTVKGRFTISRDNSKNTLYLQMNSLRAEDTAVYYCISPYYYAM EYWGQGTTVTVSSASTKGPSVFPLAPCSRSTSESTAALGCLVKDYFPEPVT VSWNSGALTSGVHTFPAVLQSSGLYSLSSVVTVPSSSLGTKTYTCNVDHK PSNTKVDKRVESKYGPPCPPCPAPEFLGGPSVFLFPPKPKDTLMISRTPEVT CVVVDVSQEDPEVQFNWYVDGVEVHNAKTKPREEQFNSTYRVVSVLTV LHQDWLNGKEYKCKVSNKGLPSSIEKTISKAKGQPREPQVYTLPPSQEEM TKNQVSLTCLVKGFYPSDIAVEWESNGQPENNYKTTPPVLDSDGSFFLYS RLTVDKSRWQEGNVFSCSVMHEALHNHYTQKSLSLSLGK | | |
| BCP-109 (AS0718 9TKDV H11-mutated hIgG1 hinge-PD1BM min) | 318 | EVQLVESGGGLVQPGGSLRLSCAASGDSPSVNYMGWFRQAPGKGREEVS SIYPTGGTFYTDSVKGRFTISRDNAKNTLYLQMNSLRPEDTAVYYCAAGK WGTDYWGQGTLVTVSS<u>EPKSSDKTHTSPPSP</u>EVQLVESGGGLVQPGGSLR LSCAASGFVFSRYDMAWVRQAPGKGLEWVSFISGGGSNTYYPDTVKGRF TISRDNSKNTLYLQMNSLRAEDTAVYYCISPYYYAMEYWGQGTTVTVSS ASTKGPSVFPLAPCSRSTSESTAALGCLVKDYFPEPVTVSWNSGALTSGVH TFPAVLQSSGLYSLSSVVTVPSSSLGTKTYTCNVDHKPSNTKVDKRVESK YGPPCPPCPAPEFLGGPSVFLFPPKPKDTLMISRTPEVTCVVVDVSQEDPEV QFNWYVDGVEVHNAKTKPREEQFNSTYRVVSVLTVLHQDWLNGKEYKC KVSNKGLPSSIEKTISKAKGQPREPQVYTLPPSQEEMTKNQVSLTCLVKGF YPSDIAVEWESNGQPENNYKTTPPVLDSDGSFFLYSRLTVDKSRWQEGNV FSCSVMHEALHNHYTQKSLSLSLGK | | |

TABLE 7-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-73C (Keytruda-mutated hIgG1 hinge-A34311 VH11) | 319 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK <u>EPKSSDKTHTSPPSP</u>EVQLVESGGGVVQPGRSLRLSCAASGRTITTITMGW FRQAPGKGREFVASHSWTDNNPYYADSVKGRFTISRDNAKNTLYLQMNS LRPEDTAVYYCAATARRSFVGRQWYTEARQYDYWGQGTLVTVSS | 159 | EIVLTQSP ATLSLSP GERATLS CRASKGV STSGYSY LHWYQQ KPGQAPR LLIYLAS YLESGVP ARFSGSG SGTDFTL TISSLEPE DFAVYYC QHSRDLP LTFGGGT KVEIKRT VAAPSVF IFPPSDEQ LKSGTAS VVCLLNN FYPREAK VQWKVD NALQSGN SQESVTE QDSKDST YSLSSTLT LSKADYE KHKVYA CEVTHQG LSSPVTK SFNRGEC |
| BCP-74C (Keytruda-mutated hIgG1 hinge-AS07014 VH11) | 320 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK <u>EPKSSDKTHTSPPSP</u>EVQLVESGGGLVQPGGSLRLSCAASGYTYSRHCLG WFRQAPGKGREAVSTIDSDGSTSYADSVKGRFTISRDNAKNTLYLQMNSL RPEDTAVYYCAIGPNPRYCSGAPNTRGAEHYFGYWGQGTLVTVSS | | |
| BCP-75C (Keytruda-mutated hIgG1 hinge-AS07189 TKDVH11) | 321 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK <u>EPKSSDKTHTSPPSP</u>EVQLVESGGGLVQPGGSLRLSCAASGDSPSVNYMG WFRQAPGKGREEVSSIYPTGGTFYTDSVKGRFTISRDNAKNTLYLQMNSL RPEDTAVYYCAAGKWGTDYWGQGTLVTVSS | | |
| BCP-90C (Keytruda-mutated hIgG1 hinge-AS07014 VH11SGQ) | 322 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK <u>EPKSSDKTHTSPPSP</u>EVQLVESGGGLVQPGGSLRLSCAASGYTYSRHCLG WFRQAPGKGREAVSTISSGGSTSYADSVKGRFTISRDNAKNTLYLQMNSL RPEDTAVYYCAIGPNPRYCSGAPQTRGAEHYFGYWGQGTLVTVSS | | |
| BCP-91C (Keytruda-mutated humanized IgG1 linker AS07189 TKDVH 11FY) | 323 | QVQLVQSGVEVKKPGASVKVSCKASGYTFTNYYMYWVRQAPGQGLEW MGGINPSNGGTNFNEKFKNRVTLTTDSSTTTAYMELKSLQFDDTAVYYC ARRDYRFDMGFDYWGQGTTVTVSSASTKGPSVFPLAPCSRSTSESTAALG CLVKDYFPEPVTVSWNSGALTSGVHTFPAVLQSSGLYSLSSVVTVPSSSLG TKTYTCNVDHKPSNTKVDKRVESKYGPPCPPCPAPEFLGGPSVFLFPPKPK DTLMISRTPEVTCVVVDVSQEDPEVQFNWYVDGVEVHNAKTKPREEQFN STYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPV LDSDGSFFLYSRLTVDKSRWQEGNVFSCSVMHEALHNHYTQKSLSLSLGK <u>EPKSSDKTHTSPPSP</u>EVQLVESGGGLVQPGGSLRLSCAASGFSPSVNYMG WFRQAPGKGREEVSSIYPTGGTFYTDSVKGRFTISRDNAKNTLYLQMNSL RPEDTAVYYCAAGKYGTDYWGQGTLVTVSS | | |
| BCP-78C (Opdivo-mutated hIgG1 hinge-A34311 VH11) | 324 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGK<u>EPKSSDKT HTSPPSP</u>EVQLVESGGGVVQPGRSLRLSCAASGRTITTITMGWFRQAPGKG REFVASHSWTDNNPYYADSVKGRFTISRDNAKNTLYLQMNSLRPEDTAV YYCAATARRSFVGRQWYTEARQYDYWGQGTLVTVSS | 161 | EIVLTQSP ATLSLSP GERATLS CRASQSV SSYLAWY QQKPGQ APRLLIY DASNRAT GIPARFSG SGSGTDF TLTISSLE PEDFAVY |

TABLE 7-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-79C (Opdivo-mutated hIgG1 hinge-AS07014 VH11) | 325 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGK<u>EPKSSDK THTSPPSP</u>EVQLVESGGGLVQPGGSLRLSCAASGYTYSRHCLGWFRQAPG KGREAVSTIDSDGSTSYADSVKGRFTISRDNAKNTLYLQMNSLRPEDTAV YYCAIGPNPRYCSGAPNTRGAEHYFGYWGQGTLVTVSS | | YCQQSSN WPRTFGQ GTKVEIK RTVAAPS VFIFPPSD EQLKSGT ASVVCLL NNFYPRE AKVQWK VDNALQS GNSQESV TEQDSKD |
| BCP-80C (Opdivo-mutated hIgG1 hinge-AS07189 TKDVH11) | 326 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGK<u>EPKSSDK THTSPPSP</u>EVQLVESGGGLVQPGGSLRLSCAASGDSPSVNYMGWFRQAPG KGREEVSSIYPTGGTFYTDSVKGRFTISRDNAKNTLYLQMNSLRPEDTAV YYCAAGKWGTDYWGQGTLVTVSS | | STYSLSST LTLSKAD YEKHKV YACEVTH QGLSSPV TKSFNRG EC |
| BCP-94C (Opdivo-mutated hIgG1 hinge-AS07014 VH11SGQ) | 327 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGK<u>EPKSSDK THTSPPSP</u>EVQLVESGGGLVQPGGSLRLSCAASGYTYSRHCLGWFRQAPG KGREAVSTISSGGSTSYADSVKGRFTISRDNAKNTLYLQMNSLRPEDTAV YYCAIGPNPRYCSGAPTRGAEHYFGYWGQGTLVTVSS | | |
| BCP-95C (Opdivo-mutated hIgG1 hinge-AS07189 TKDVH 11FY) | 328 | QVQLVESGGGVVQPGRSLRLDCKASGITFSNSGMHWVRQAPGKGLEWV AVIWYDGSKRYYADSVKGRFTISRDNSKNTLFLQMNSLRAEDTAVYYCA TNDDYWGQGTLVTVSSASTKGPSVFPLAPCSRSTSESTAALGCLVKDYFP EPVTVSWNSGALTSGVHTFPAVLQSSGLYSLSSVVTVPSSSLGTKTYTCNV DHKPSNTKVDKRVESKYGPPCPPCPAPEFLGGPSVFLFPPKPKDTLMISRTP EVTCVVVDVSQEDPEVQFNWYVDGVEVHNAKTKPREEQFNSTYRVVSV LTVLHQDWLNGKEYKCKVSNKGLPSSIEKTISKAKGQPREPQVYTLPPSQ EEMTKNQVSLTCLVKGFYPSDIAVEWESNGQPENNYKTTPPVLDSDGSFF LYSRLTVDKSRWQEGNVFSCSVMHEALHNHYTQKSLSLSLGK<u>EPKSSDK THTSPPSP</u>EVQLVESGGGLVQPGGSLRLSCAASGFSPSVNYMGWFRQAPG KGREEVSSIYPTGGTFYTDSVKGRFTISRDNAKNTLYLQMNSLRPEDTAV YYCAAGKYGTDYWGQGTLVTVSS | | |
| BCP-100C (PD1BM min-mutated hIgG1 hinge-AS07189 TKDVH 11FY) | 329 | EVQLVESGGGLVQPGGSLRLSCAASGFVFSRYDMAWVRQAPGKGLEWV SFISGGGSNTYYPDTVKGRFTISRDNSKNTLYLQMNSLRAEDTAVYYCISP YYYAMEYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK<u>EPKSSDK THTSPPSP</u>EVQLVESGGGLVQPGGSLRLSCAASGFSPSVNYMGWFRQAPG KGREEVSSIYPTGGTFYTDSVKGRFTISRDNAKNTLYLQMNSLRPEDTAV YYCAAGKYGTDYWGQGTLVTVSS | 309 | DIQMTQS PSSVSAS VGDRVTI TCKASQD VDTAVA WYQQKP GKAPKLL IYWASTR HTGVPSR FSGSGSG TDFTLTIS SLQPEDF ATYYCQ QYSTFPW TFGGGTK VEIKRTV AAPSVFIF PPSDEQL KSGTASV VCLLNNF YPREAKV QWKVDN ALQSGNS QESVTEQ |
| BCP-101C (PD1BM min-mutated hIgG1 hinge-AS07014 VH11SGQ) | 330 | EVQLVESGGGLVQPGGSLRLSCAASGFVFSRYDMAWVRQAPGKGLEWV SFISGGGSNTYYPDTVKGRFTISRDNSKNTLYLQMNSLRAEDTAVYYCISP YYYAMEYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK<u>EPKSSDK THTSPPSP</u>EVQLVESGGGLVQPGGSLRLSCAASGYTYSRHCLGWFRQAPG KGREAVSTISSGGSTSYADSVKGRFTISRDNAKNTLYLQMNSLRPEDTAV YYCAIGPNPRYCSGAPQTRGAEHYFGYWGQGTLVTVSS | | |

TABLE 7-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-103C (PD1BM min-mutated hIgG1 hinge-AS07189 TKDVH 21FY) | 331 | EVQLVESGGGLVQPGGSLRLSCAASGFVFSRYDMAWVRQAPGKGLEWV SFISGGGSNTYYPDTVKGRFTISRDNSKNTLYLQMNSLRAEDTAVYYCISP YYYAMEYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK<u>EPKSSDK THTSPPSP</u>EVQLVESGGGLVQPGGSLRLSCAASGFSPSVNYMGWVRQAPG KGLEEVSSIYPTGGTFYTDSVKGRFTISRDNSKNTLYLQMNSLRAEDTAVY YCAAGKYGTDYWGQGTLVTVSS | | DSKDSTY SLSSTLTL SKADYEK HKVYAC EVTHQGL SSPVTKSF NRGEC |
| BCP-104C (PD1BM min-mutated hIgG1 hinge-A34311 VH2) | 332 | EVQLVESGGGLVQPGGSLRLSCAASGFVFSRYDMAWVRQAPGKGLEWV SFISGGGSNTYYPDTVKGRFTISRDNSKNTLYLQMNSLRAEDTAVYYCISP YYYAMEYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK<u>EPKSSDK THTSPPSP</u>EVQLVESGGGVVQPGRSLRLSCAASGRTITTITMGWFRQAPGK GLEFVASHSWTDNNPYYADSVKGRFTISRDNSKNTLYLQMNSLRAEDTA VYYCAATARRSFVGRQWYTEARQYDYWGQGTLVTVSS | | |
| BCP-105C (PD1BM min-mutated hIgG1 hinge-A34311 VH2F53) | 333 | EVQLVESGGGLVQPGGSLRLSCAASGFVFSRYDMAWVRQAPGKGLEWV SFISGGGSNTYYPDTVKGRFTISRDNSKNTLYLQMNSLRAEDTAVYYCISP YYYAMEYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK<u>EPKSSDK THTSPPSP</u>EVQLVESGGGVVQPGRSLRLSCAASGRTITTITMGWFRQAPGK GLEFVASHSFTDNNPYYADSVKGRFTISRDNSKNTLYLQMNSLRAEDTAV YYCAATARRSFVGRQWYTEARQYDYWGQGTLVTVSS | | |
| BCP-106C (PD1BM min-mutated hIgG1 hinge-A34311 VH11) | 334 | EVQLVESGGGLVQPGGSLRLSCAASGFVFSRYDMAWVRQAPGKGLEWV SFISGGGSNTYYPDTVKGRFTISRDNSKNTLYLQMNSLRAEDTAVYYCISP YYYAMEYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK<u>EPKSSDK THTSPPSP</u>EVQLVESGGGVVQPGRSLRLSCAASGRTITTITMGWFRQAPGK GREFVASHSWTDNNPYYADSVKGRFTISRDNAKNTLYLQMNSLRPEDTA VYYCAATARRSFVGRQWYTEARQYDYWGQGTLVTVSS | | |
| BCP-107C (PD1BM min-mutated hIgG1 hinge-A34311 VH11F53) | 335 | EVQLVESGGGLVQPGGSLRLSCAASGFVFSRYDMAWVRQAPGKGLEWV SFISGGGSNTYYPDTVKGRFTISRDNSKNTLYLQMNSLRAEDTAVYYCISP YYYAMEYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK<u>EPKSSDK THTSPPSP</u>EVQLVESGGGVVQPGRSLRLSCAASGRTITTITMGWFRQAPGK GREFVASHSFTDNNPYYADSVKGRFTISRDNAKNTLYLQMNSLRPEDTAV YYCAATARRSFVGRQWYTEARQYDYWGQGTLVTVSS | | |
| BCP-108C (PD1BM min-mutated hIgG1 hinge-AS07014 VH11) | 336 | EVQLVESGGGLVQPGGSLRLSCAASGFVFSRYDMAWVRQAPGKGLEWV SFISGGGSNTYYPDTVKGRFTISRDNSKNTLYLQMNSLRAEDTAVYYCISP YYYAMEYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK<u>EPKSSDK THTSPPSP</u>EVQLVESGGGLVQPGGSLRLSCAASGYTYSRHCLGWFRQAPG KGREAVSTIDSDGSTSYADSVKGRFTISRDNAKNTLYLQMNSLRPEDTAV YYCAIGPNPRYCSGAPNTRGAEHYFGYWGQGTLVTVSS | | |

TABLE 7-continued

Anti-CTLA-4/PD-1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-109C (PD1BM min-mutated hIgG1 hinge-AS07189 TKDVH 11) | 337 | EVQLVESGGGLVQPGGSLRLSCAASGFVFSRYDMAWVRQAPGKGLEWV SFISGGGSNTYYPDTVKGRFTISRDNSKNTLYLQMNSLRAEDTAVYYCISP YYYAMEYWGQGTTVTVSSASTKGPSVFPLAPCSRSTSESTAALGCLVKDY FPEPVTVSWNSGALTSGVHTFPAVLQSSGLYSLSSVVTVPSSSLGTKTYTC NVDHKPSNTKVDKRVESKYGPPCPPCPAPEFLGGPSVFLFPPKPKDTLMIS RTPEVTCVVVDVSQEDPEVQFNWYVDGVEVHNAKTKPREEQFNSTYRVV SVLTVLHQDWLNGKEYKCKVSNKGLPSSIEKTISKAKGQPREPQVYTLPPS QEEMTKNQVSLTCLVKGFYPSDIAVEWESNGQPENNYKTTPPVLDSDGSF FLYSRLTVDKSRWQEGNVFSCSVMHEALHNHYTQKSLSLSLGK<u>EPKSSDK THTSPPSP</u>EVQLVESGGGLVQPGGSLRLSCAASGDSPSVNYMGWFRQAPG KGREEVSSIYPTGGTFYTDSVKGRFTISRDNAKNTLYLQMNSLRPEDTAV YYCAAGKWGTDYWGQGTLVTVSS | | |

TABLE 8

Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-83 (A34311 VH11-mutated hIgG1 hinge-Tecentriq) | 302 | EVQLVESGGGVVQPGRSLRLSCAASGRTITTITMGWFRQAPGKGREFVAS HSWTDNNPYYADSVKGRFTISRDNAKNTLYLQMNSLRPEDTAVYYCAAT ARRSFVGRQWYTEARQYDYWGQGTLVTVSS<u>EPKSSDKTHTSPPSP</u>EVQL VESGGGLVQPGGSLRLSCAASGFTFSDSWIHWVRQAPGKGLEWVAWISP YGGSTYYADSVKGRFTISADTSKNTAYLQMNSLRAEDTAVYYCARRHWP GGFDYWGQGTLVTVSSASTKGPSVFPLAPSSKSTSGGTAALGCLVKDYFP EPVTVSWNSGALTSGVHTFPAVLQSSGLYSLSSVVTVPSSSLGTQTYICNV NHKPSNTKVDKKVEPKSCDKTHTCPPCPAPELLGGPSVFLFPPKPKDTLMI SRTPEVTCVVVDVSHEDPEVKFNWYVDGVEVHNAKTKPREEQYASTYRV VSVLTVLHQDWLNGKEYKCKVSNKALPAPIEKTISKAKGQPREPQVYTLP PSREEMTKNQVSLTCLVKGFYPSDIAVEWESNGQPENNYKTTPPVLDSDG SFFLYSKLTVDKSRWQQGNVFSCSVMHEALHNHYTQKSLSLSPGK | 196 | DIQMTQS PSSLSASV GDRVTIT CRASQDV STAVAW YQQKPG KAPKLLI YSASFLY SGVPSRF SGSGSGT DFTLTISS LQPEDFA TYYCQQ YLYHPAT FGQGTKV EIKRTVA APSVFIFP PSDEQLK SGTASVV CLLNNFY PREAKVQ WKVDNA LQSGNSQ ESVTEQD SKDSTYS LSSTLTLS KADYEK HKVYAC EVTHQGL SSPVTKSF NRGEC |
| BCP-84 (AS07014 VH11-mutated hIgG1 hinge-Tecentriq) | 303 | EVQLVESGGGLVQPGGSLRLSCAASGYTYSRHCLGWFRQAPGKGREAVS TIDSDGSTSYADSVKGRFTISRDNAKNTLYLQMNSLRPEDTAVYYCAIGPN PRYCSGAPNTRGAEHYFGYWGQGTLVTVSS<u>EPKSSDKTHTSPPSP</u>EVQLV ESGGGLVQPGGSLRLSCAASGFTFSDSWIHWVRQAPGKGLEWVAWISPY GGSTYYADSVKGRFTISADTSKNTAYLQMNSLRAEDTAVYYCARRHWPG GFDYWGQGTLVTVSSASTKGPSVFPLAPSSKSTSGGTAALGCLVKDYFPE PVTVSWNSGALTSGVHTFPAVLQSSGLYSLSSVVTVPSSSLGTQTYICNVN HKPSNTKVDKKVEPKSCDKTHTCPPCPAPELLGGPSVFLFPPKPKDTLMIS RTPEVTCVVVDVSHEDPEVKFNWYVDGVEVHNAKTKPREEQYASTYRV VSVLTVLHQDWLNGKEYKCKVSNKALPAPIEKTISKAKGQPREPQVYTLP PSREEMTKNQVSLTCLVKGFYPSDIAVEWESNGQPENNYKTTPPVLDSDG SFFLYSKLTVDKSRWQQGNVFSCSVMHEALHNHYTQKSLSLSPGK | | |
| BCP-85 (AS07189 TKDV H11-mutated hIgG1 hinge-Tecentriq) | 304 | EVQLVESGGGLVQPGGSLRLSCAASGDSPSVNYMGWFRQAPGKGREEVS SIYPTGGTFYTDSVKGRFTISRDNAKNTLYLQMNSLRPEDTAVYYCAAGK WGTDYWGQGTLVTVSS<u>EPKSSDKTHTSPPSP</u>EVQLVESGGGLVQPGGSLR LSCAASGFTFSDSWIHWVRQAPGKGLEWVAWISPYGGSTYYADSVKGRF TISADTSKNTAYLQMNSLRAEDTAVYYCARRHWPGGFDYWGQGTLVTV SSASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSH EDPEVKFNWYVDGVEVHNAKTKPREEQYASTYRVVSVLTVLHQDWLNG KEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRW QQGNVFSCSVMHEALHNHYTQKSLSLSPGK | | |
| BCP-92 (AS07014 VH11S GQ-mutated hIgG1 hinge-Tecentriq) | 305 | EVQLVESGGGLVQPGGSLRLSCAASGYTYSRHCLGWFRQAPGKGREAVS TISSGGSTSYADSVKGRFTISRDNAKNTLYLQMNSLRPEDTAVYYCAIGPN PRYCSGAPQTRGAEHYFGYWGQGTLVTVSS<u>EPKSSDKTHTSPPSP</u>EVQLV ESGGGLVQPGGSLRLSCAASGFTFSDSWIHWVRQAPGKGLEWVAWISPY GGSTYYADSVKGRFTISADTSKNTAYLQMNSLRAEDTAVYYCARRHWPG GFDYWGQGTLVTVSSASTKGPSVFPLAPSSKSTSGGTAALGCLVKDYFPE PVTVSWNSGALTSGVHTFPAVLQSSGLYSLSSVVTVPSSSLGTQTYICNVN HKPSNTKVDKKVEPKSCDKTHTCPPCPAPELLGGPSVFLFPPKPKDTLMIS RTPEVTCVVVDVSHEDPEVKFNWYVDGVEVHNAKTKPREEQYASTYRV VSVLTVLHQDWLNGKEYKCKVSNKALPAPIEKTISKAKGQPREPQVYTLP PSREEMTKNQVSLTCLVKGFYPSDIAVEWESNGQPENNYKTTPPVLDSDG SFFLYSKLTVDKSRWQQGNVFSCSVMHEALHNHYTQKSLSLSPGK | | |

TABLE 8-continued

Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|
| BCP-93 (A507189 TKDV H11FY-mutated hIgG1 hinge-Tecentriq) | 306 | EVQLVESGGGLVQPGGSLRLSCAASGFSPSVNYMGWFRQAPGKGREEVS SIYPTGGTFYTDSVKGRFTISRDNAKNTLYLQMNSLRPEDTAVYYCAAGK YGTDYWGQGTLVTVSS<u>EPKSSDKTHTSPPSP</u>EVQLVESGGGLVQPGGSLR LSCAASGFTFSDSWIHWVRQAPGKGLEWVAWISPYGGSTYYADSVKGRF TISADTSKNTAYLQMNSLRAEDTAVYYCARRHWPGGFDYWGQGTLVTV SSASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSH EDPEVKFNWYVDGVEVHNAKTKPREEQYASTYRVVSVLTVLHQDWLNG KEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRW QQGNVFSCSVMHEALHNHYTQKSLSLSPGK | | |
| BCP-83C (Tecentriq-mutated hIgG1 hinge-A34311 VH11) | 345 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK <u>EPKSSDKTHTSPPSP</u>EVQLVESGGGVVQPGRSLRLSCAASGRTITTITMGW FRQAPGKGREFVASHSWTDNNPYYADSVKGRFTISRDNAKNTLYLQMNS LRPEDTAVYYCAATARRSFVGRQWYTEARQYDYWGQGTLVTVSS | 196 | DIQMTQS PSSLSASV GDRVTIT CRASQDV STAVAW YQQKPG KAPKLLI YSASFLY SGVPSRF SGSGSGT DFTLTISS LQPEDFA TYYCQQ YLYHPAT FGQGTKV EIKRTVA APSVFIFP PSDEQLK SGTASVV CLLNNFY PREAKVQ WKVDNA LQSGNSQ ESVTEQD SKDSTYS LSSTLTLS KADYEK HKVYAC EVTHQGL SSPVTKSF NRGEC |
| BCP-84C (Tecentriq-mutated hIgG1 hinge-A507014 VH11) | 346 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK <u>EPKSSDKTHTSPPSP</u>EVQLVESGGGLVQPGGSLRLSCAASGYTYSRHCLG WFRQAPGKGREAVSTIDSDGSTSYADSVKGRFTISRDNAKNTLYLQMNSL RPEDTAVYYCAIGPNPRYCSGAPNTRGAEHYFGYWGQGTLVTVSS | | |
| BCP-85C (Tecentriq-mutated hIgG1 hinge-AS07189 TKDVH 11) | 347 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK <u>EPKSSDKTHTSPPSP</u>EVQLVESGGGLVQPGGSLRLSCAASGDSPSVNYMG WFRQAPGKGREEVSSIYPTGGTFYTDSVKGRFTISRDNAKNTLYLQMNSL RPEDTAVYYCAAGKWGTDYWGQGTLVTVSS | | |
| BCP-92C (Tecentriq-mutated hIgG1 hinge-AS07014 VH11SGQ) | 348 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK <u>EPKSSDKTHTSPPSP</u>EVQLVESGGGLVQPGGSLRLSCAASGYTYSRHCLG WFRQAPGKGREAVSTISSGGSTSYADSVKGRFTISRDNAKNTLYLQMNSL RPEDTAVYYCAIGPNPRYCSGAPQTRGAEHYFGYWGQGTLVTVSS | | |
| BCP-93C (Tecentriq-mutated hIgG1 hinge-AS07189 TKDVH 11FY) | 349 | EVQLVESGGGLVQPGGSLRLSCAASGFTFSDSWIHWVRQAPGKGLEWVA WISPYGGSTYYADSVKGRFTISADTSKNTAYLQMNSLRAEDTAVYYCAR RHWPGGFDYWGQGTLVTVSSASTKGPSVFPLAPSSKSTSGGTAALGCLVK DYFPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYAS TYRVVSVLTVLHQDWLNGKEYKCKVSNKALPAPIEKTISKAKGQPREPQV YTLPPSREEMTKNQVSLTCLVKGFYPSDIAVEWESNGQPENNYKTTPPVL DSDGSFFLYSKLTVDKSRWQQGNVFSCSVMHEALHNHYTQKSLSLSPGK <u>EPKSSDKTHTSPPSP</u>EVQLVESGGGLVQPGGSLRLSCAASGFSPSVNYMG WFRQAPGKGREEVSSIYPTGGTFYTDSVKGRFTISRDNAKNTLYLQMNSL RPEDTAVYYCAAGKYGTDYWGQGTLVTVSS | | |

TABLE 8-continued

Anti-CTLA-4/PD-L1 bispecific antibody sequences

| Construct name | SEQ ID NO | Heavy chain fusion amino acid sequence (linker peptide is underlined) | SEQ ID NO | Light chain amino acid sequence |
|---|---|---|---|---|

SEQ ID NO: 307 (mutated human IgG1 (hIgG1) hinge amino acid sequences)
EPKSSDKTHTSPPSP SEQ ID NO: 308 (PD1BMmin heavy chain amino acid sequence)
EVQLVESGGGLVQPGGSLRLSCAASGFVFSRYDMAWVRQAPGKGLEWVSFISGGGSNTYYPDTVKGRFTI
SRDNSKNTLYLQMNSLRAEDTAVYYCISPYYYAMEYWGQGTTVIVSSASTKGPSVFPLAPCSRSTSESTAA
LGCLVKDYFPEPVTVSWNSGALTSGVHTFPAVLQSSGLYSLSSVVTVPSSSLGTKTYTCNVDHKPSNTKVD
KRVESKYGPPCPPCPAPEFLGGPSVFLFPPKPKDTLMISRTPEVTCVVVDVSQEDPEVQFNWYVDGVEVHN
AKTKPREEQFNSTYRVVSVLTVLHQDWLNGKEYKCKVSNKGLPSSIEKTISKAKGQPREPQVYTLPPSQEE
MTKNQVSLTCLVKGFYPSDIAVEWESNGQPENNYKTTPPVLDSDGSFFLYSRLTVDKSRWQEGNVFSCSV
MHEALHNHYTQKSLSLSLGK SEQ ID NO: 341 (AS07189TKDVH21FY humanized sdAb amino acid sequence; CDRs are underlined)
EVQLVESGGGLVQPGGSLRLSCAAS<u>GFSPSVNYMG</u>WVRQAPGKGLEEVS<u>SIYPTGGTFYTDSVKG</u>RFTISR
DNSKNTLYLQMNSLRAEDTAVYYCAA<u>GKYGTDY</u>WGQGTLVTVSS SEQ ID NO: 342 (A34311VH2 humanized sdAb amino acid sequence; CDRs are underlined)
EVQLVESGGGVVQPGRSLRLSCAAS<u>GRTITTITMG</u>WFRQAPGKGLEFVA<u>SHSWTDNNPYYADSVKG</u>RFTIS
RDNSKNTLYLQMNSLRAEDTAVYYCAA<u>TARRSFVGRQWYTEARQYDY</u>WGQGTLVTVSS SEQ ID NO: 343 (A34311VH2F53 humanized sdAb amino acid sequence; CDRs are underlined)
EVQLVESGGGVVQPGRSLRLSCAAS<u>GRTITTITMG</u>WFRQAPGKGLEFVA<u>SHSFTDNNPYYADSVKG</u>RFTIS
RDNSKNTLYLQMNSLRAEDTAVYYCAA<u>TARRSFVGRQWYTEARQYDY</u>WGQGTLVTVSS SEQ ID NO: 344 (A34311VH11F53 humanized sdAb amino acid sequence; CDRs are underlined)
EVQLVESGGGVVQPGRSLRLSCAAS<u>GRTITTITMG</u>WFRQAPGKGREFVA<u>SHSFTDNNPYYADSVKG</u>RFTIS
RDNAKNTLYLQMNSLRPEDTAVYYCAA<u>TARRSFVGRQWYTEARQYDY</u>WGQGTLVTVSS SEQ ID NO: 352 (AS07014 direct grafted humanized sdAb amino acid sequence; CDRs are underlined)
EVQLVESGGGLVQPGGSLRLSCAAS<u>GYTYSRHCLG</u>WVRQAPGKGLEWVS<u>TIDSDGSTSYADSVKG</u>RFTISR
DNSKNTLYLQMNSLRAEDTAVYYCAR<u>GPNPRYCSGAPNTRGAEHYFGY</u>WGQGTLVTVSS SEQ ID NO: 353 (AS07189 direct grafted humanized sdAb amino acid sequence; CDRs are underlined)
EVQLVESGGGLVQPGGSLRLSCAAS<u>GFSPSVNYMG</u>WVRQAPGKGLEWVS<u>SIYPTGGTFYTDSVKG</u>RFTISR
DNSKNTLYLQMNSLRAEDTAVYYCAR<u>GKWGTDY</u>WGQGTLVTVSS

TABLE 9

Anti-CTLA-4/PD-1 bispecific antibody sequences

| Construct name and description | SEQ ID NO | Amino acid sequence |
|---|---|---|
| BCP-16 (A34311-hIgG1 hinge-Keytruda) (A34311 fused to N-terminus of Keytruda light chain) | 158 | (heavy chain)<br>QVQLVQSGVEVKKPGASVKVSCKASGYTFTNYYMYWVRQAPGQGLEWMGGINPSNGGT<br>NFNEKFKNRVTLTTDSSTTTAYMELKSLQFDDTAVYYCARRDYRFDMGFDYWGQGTTVT<br>VSSASTKGPSVFPLAPCSRSTSESTAALGCLVKDYFPEPVTVSWNSGALTSGVHTFPAVLQS<br>SGLYSLSSVVTVPSSSLGTKTYTCNVDHKPSNTKVDKRVESKYGPPCPPCPAPEFLGGPSVF<br>LFPPKPKDTLMISRTPEVTCVVVDVSQEDPEVQFNWYVDGVEVHNAKTKPREEQFNSTYR<br>VVSVLTVLHQDWLNGKEYKCKVSNKGLPSSIEKTISKAKGQPREPQVYTLPPSQEEMTKN<br>QVSLTCLVKGFYPSDIAVEWESNGQPENNYKTTPPVLDSDGSFFLYSRLTVDKSRWQEGN<br>VFSCSVMHEALHNHYTQKSLSLSLGK |
| | 354 | (light chain fusion polypeptide; linker peptide is bolded; anti-CTLA-4 sdAb is underlined)<br><u>QVKLEESGGGLVLPGESLRLSCEASGRTITTITMGWFRQAPGKERQFVASHSWTDNNPYY</u><br><u>ADSVKGRFIISRDNAGNRVYLQMHSLEPEDTAVYYCAATARRSFVGRQWYTEARQYDYW</u><br><u>GQGTQVTVSS</u>EPKSCDKTHTCPPCPEIVLTQSPATLSLSPGERATLSCRASKGVSTSGYSY<br>LHWYQQKPGQAPRLLIYLASYLESGVPARFSGSGSGTDFTLTISSLEPEDFAVYYCQHSRDL<br>PLTFGGGTKVEIKRTVAAPSVFIFPPSDEQLKSGTASVVCLLNNFYPREAKVQWKVDNALQ<br>SGNSQESVTEQDSKDSTYSLSSTLTLSKADYEKHKVYACEVTHQGLSSPVTKSFNRGEC |
| BCP-17 (Keytruda-hIgG1 hinge-A34311) (A34311 fused to C-terminus of Keytruda light chain) | 158 | (heavy chain)<br>QVQLVQSGVEVKKPGASVKVSCKASGYTFTNYYMYWVRQAPGQGLEWMGGINPSNGGT<br>NFNEKFKNRVTLTTDSSTTTAYMELKSLQFDDTAVYYCARRDYRFDMGFDYWGQGTTVT<br>VSSASTKGPSVFPLAPCSRSTSESTAALGCLVKDYFPEPVTVSWNSGALTSGVHTFPAVLQS<br>SGLYSLSSVVTVPSSSLGTKTYTCNVDHKPSNTKVDKRVESKYGPPCPPCPAPEFLGGPSVF<br>LFPPKPKDTLMISRTPEVTCVVVDVSQEDPEVQFNWYVDGVEVHNAKTKPREEQFNSTYR<br>VVSVLTVLHQDWLNGKEYKCKVSNKGLPSSIEKTISKAKGQPREPQVYTLPPSQEEMTKN<br>QVSLTCLVKGFYPSDIAVEWESNGQPENNYKTTPPVLDSDGSFFLYSRLTVDKSRWQEGN<br>VFSCSVMHEALHNHYTQKSLSLSLGK |

TABLE 9-continued

Anti-CTLA-4/PD-1 bispecific antibody sequences

| Construct name and description | SEQ ID NO | Amino acid sequence |
|---|---|---|
| | 355 | (light chain fusion polypeptide; linker peptide is bolded; anti-CTLA-4 sdAb is underlined)<br>EIVLTQSPATLSLSPGERATLSCRASKGVSTSGYSYLHWYQQKPGQAPRLLIYLASYLESGV<br>PARFSGSGSGTDFTLTISSLEPEDFAVYYCQHSRDLPLTFGGGTKVEIKRTVAAPSVFIFPPSD<br>EQLKSGTASVVCLLNNFYPREAKVQWKVDNALQSGNSQESVTEQDSKDSTYSLSSTLTLS<br>KADYEKHKVYACEVTHQGLSSPVTKSFNRGECEPKSCDKTHTCPPCPQVKLEESGGGLV<br>LPGESLRLSCEASGRTITTITMGWFRQAPGKERQFVASHSWTDNNPYYADSVKGRFIISRDN<br>AGNRVYLQMHSLEPEDTAVYYCAATARRSFVGRQWYTEARQYDYWGQGTQVTVSS |
| BCP-31 (A34311-9GS linker-Keytruda) (A34311 fused to N-terminus of both Keytruda heavy chain and light chain) | 356 | (heavy chain fusion polypeptide; linker peptide is bolded; anti-CTLA-4 sdAb is underlined)<br><u>QVKLEESGGGLVLPGESLRLSCEASGRTITTITMGWFRQAPGKERQFVASHSWTDNNPYY<br>ADSVKGRFIISRDNAGNRVYLQMHSLEPEDTAVYYCAATARRSFVGRQWYTEARQYDYW<br>GQGTQVTVSS</u>GGGGSGGGSQVQLVQSGVEVKKPGASVKVSCKASGYTFTNYYMYWVR<br>QAPGQGLEWMGGINPSNGGTNFNEKFKNRVTLTTDSSTTTAYMELKSLQFDDTAVYYCA<br>RRDYRFDMGFDYWGQGTTVTVSSASTKGPSVFPLAPCSRSTSESTAALGCLVKDYFPEPVT<br>VSWNSGALTSGVHTFPAVLQSSGLYSLSSVVTVPSSSLGTKTYTCNVDHKPSNTKVDKRVE<br>SKYGPPCPPCPAPEFLGGPSVFLFPPKPKDTLMISRTPEVTCVVVDVSQEDPEVQFNWYVD<br>GVEVHNAKTKPREEQFNSTYRVVSVLTVLHQDWLNGKEYKCKVSNKGLPSSIEKTISKAK<br>GQPREPQVYTLPPSQEEMTKNQVSLTCLVKGFYPSDIAVEWESNGQPENNYKTTPPVLDSD<br>GSFFLYSRLTVDKSRWQEGNVFSCSVMHEALHNHYTQKSLSLSLGK |
| | 357 | (light chain fusion polypeptide; linker peptide is bolded; anti-CTLA-4 sdAb is underlined)<br><u>QVKLEESGGGLVLPGESLRLSCEASGRTITTITMGWFRQAPGKERQFVASHSWTDNNPYY<br>ADSVKGRFIISRDNAGNRVYLQMHSLEPEDTAVYYCAATARRSFVGRQWYTEARQYDYW<br>GQGTQVTVSS</u>GGGGSGGGSEIVLTQSPATLSLSPGERATLSCRASKGVSTSGYSYLHWYQ<br>QKPGQAPRLLIYLASYLESGVPARFSGSGSGTDFTLTISSLEPEDFAVYYCQHSRDLPLTFGG<br>GTKVEIKRTVAAPSVFIFPPSDEQLKSGTASVVCLLNNFYPREAKVQWKVDNALQSGNSQE<br>SVTEQDSKDSTYSLSSTLTLSKADYEKHKVYACEVTHQGLSSPVTKSFNRGEC |
| BCP-32 (A34311-9GS linker-A34311-9GS linker-Keytruda) (two A34311 fused to N-terminus of Keytruda heavy chain) | 358 | (heavy chain fusion polypeptide; linker peptide is bolded; anti-CTLA-4 sdAb is underlined)<br><u>QVKLEESGGGLVLPGESLRLSCEASGRTITTITMGWFRQAPGKERQFVASHSWTDNNPYY<br>ADSVKGRFIISRDNAGNRVYLQMHSLEPEDTAVYYCAATARRSFVGRQWYTEARQYDYW<br>GQGTQVTVSS</u>GGGGSGGGS<u>QVKLEESGGGLVLPGESLRLSCEASGRTITTITMGWFRQAP<br>GKERQFVASHSWTDNNPYYADSVKGRFIISRDNAGNRVYLQMHSLEPEDTAVYYCAATA<br>RRSFVGRQWYTEARQYDYWGQGTQVTVSS</u>GGGGSGGGSQVQLVQSGVEVKKPGASVK<br>VSCKASGYTFTNYYMYWVRQAPGQGLEWMGGINPSNGGTNFNEKFKNRVTLTTDSSTTT<br>AYMELKSLQFDDTAVYYCARRDYRFDMGFDYWGQGTTVTVSSASTKGPSVFPLAPCSRS<br>TSESTAALGCLVKDYFPEPVTVSWNSGALTSGVHTFPAVLQSSGLYSLSSVVTVPSSSLGTK<br>TYTCNVDHKPSNTKVDKRVESKYGPPCPPCPAPEFLGGPSVFLFPPKPKDTLMISRTPEVTC<br>VVVDVSQEDPEVQFNWYVDGVEVHNAKTKPREEQFNSTYRVVSVLTVLHQDWLNGKEY<br>KCKVSNKGLPSSIEKTISKAKGQPREPQVYTLPPSQEEMTKNQVSLTCLVKGFYPSDIAVEW<br>ESNGQPENNYKTTPPVLDSDGSFFLYSRLTVDKSRWQEGNVFSCSVMHEALHNHYTQKSL<br>SLSLGK |
| | 159 | (light chain)<br>EIVLTQSPATLSLSPGERATLSCRASKGVSTSGYSYLHWYQQKPGQAPRLLIYLASYLESGV<br>PARFSGSGSGTDFTLTISSLEPEDFAVYYCQHSRDLPLTFGGGTKVEIKRTVAAPSVFIFPPSD<br>EQLKSGTASVVCLLNNFYPREAKVQWKVDNALQSGNSQESVTEQDSKDSTYSLSSTLTLS<br>KADYEKHKVYACEVTHQGLSSPVTKSFNRGEC |
| BCP-33 (Keytruda-Fab $V_H$-$C_H$1-hIgG1 hinge-A34311-IgG1 Fc) (A34311 fused to C-terminus of Keytruda $V_H$-$C_H$1, IgG1 Fc fused to C-terminus of A34311) | 359 | (heavy chain fusion polypeptide; linker peptide is bolded; anti-CTLA-4 sdAb is underlined)<br>QVQLVQSGVEVKKPGASVKVSCKASGYTFTNYYMYWVRQAPGQGLEWMGGINPSNGGT<br>NFNEKFKNRVTLTTDSSTTTAYMELKSLQFDDTAVYYCARRDYRFDMGFDYWGQGTTVT<br>VSSASTKGPSVFPLAPSSKSTSGGTAALGCLVKDYFPEPVTVSWNSGALTSGVHTFPAVLQ<br>SSGLYSLSSVVTVPSSSLGTQTYICNVNFIKPSNTKVDKKVEPKSCDKTHTCPPCP<u>QVKLEE<br>SGGGLVLPGESLRLSCEASGRTITTITMGWFRQAPGKERQFVASHSWTDNNPYYADSVKG<br>RFIISRDNAGNRVYLQMHSLEPEDTAVYYCAATARRSFVGRQWYTEARQYDYWGQGTQV<br>TVSS</u>EPKSCDKTHTCPPCPAPELLGGPSVFLFPPKPKDTLMISRTPEVTCVVVDVSHEDPEV<br>KFNWYVDGVEVHNAKTKPREEQYNSTYRVVSVLTVLHQDWLNGKEYKCKVSNKALPAP<br>IEKTISKAKGQPREPQVYTLPPSRDELTKNQVSLTCLVKGFYPSDIAVEWESNGQPENNYKT<br>TPPVLDSDGSFFLYSKLTVDKSRWQQGNVFSCSVMHEALHNHYTQKSLSLSPGK |
| | 159 | (light chain)<br>EIVLTQSPATLSLSPGERATLSCRASKGVSTSGYSYLHWYQQKPGQAPRLLIYLASYLESGV<br>PARFSGSGSGTDFTLTISSLEPEDFAVYYCQHSRDLPLTFGGGTKVEIKRTVAAPSVFIFPPSD<br>EQLKSGTASVVCLLNNFYPREAKVQWKVDNALQSGNSQESVTEQDSKDSTYSLSSTLTLS<br>KADYEKHKVYACEVTHQGLSSPVTKSFNRGEC |
| BCP-34 (Keytruda-scFv-hIgG1 | 360 | (linker peptide is bolded; anti-CTLA-4 sdAb is underlined)<br>EIVLTQSPATLSLSPGERATLSCRASKGVSTSGYSYLHWYQQKPGQAPRLLIYLASYLESGV<br>PARFSGSGSGTDFTLTISSLEPEDFAVYYCQHSRDLPLTFGGGTKVEIKGGGGSGGGGSGG |

TABLE 9-continued

Anti-CTLA-4/PD-1 bispecific antibody sequences

| Construct name and description | SEQ ID NO | Amino acid sequence |
|---|---|---|
| hinge-A34311-IgG1 Fc) | | GGSQVQLVQSGVEVKKPGASVKVSCKASGYTFTNYYMYWVRQAPGQGLEWMGGINPSN GGTNFNEKFKNRVTLTTDSSTTTAYMELKSLQFDDTAVYYCARRDYRFDMGFDYWGQGT TVTVSSEPKSCDKTHTCPPCPQVKLEESGGGLVLPGESLRLSCEASGRTITTITMGWFRQA PGKERQFVASHSWTDNNPYYADSVKGRFIISRDNAGNRVYLQMHSLEPEDTAVYYCAAT ARRSFVGRQWYTEARQYDYWGQGTQVTVSSEPKSCDKTHTCPPCPAPELLGGPSVFLFPP KPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGQPREPQVYTLPPSRDELTKNQVSL TCLVKGFYPSDIAVEWESNGQPENNYKTTPPVLDSDGSFFLYSKLTVDKSRWQQGNVFSCS VMHEALHNHYTQKSLSLSPGK |
| BCP-35 (Keytruda-Fab $V_H$-$C_H$1-hIgG1 hinge-A34311-$C_H$1-IgG4 Fc, Keytruda-Fab $V_L$-$C_L$-hIgG1 hinge-A34311-$C_L$) | 361 | (heavy chain fusion polypeptide; linker peptide is bolded; anti-CTLA-4 sdAb is underlined) QVQLVQSGVEVKKPGASVKVSCKASGYTFTNYYMYWVRQAPGQGLEWMGGINPSNGGT NFNEKFKNRVTLTTDSSTTTAYMELKSLQFDDTAVYYCARRDYRFDMGFDYWGQGTTVT VSSASTKGPSVFPLAPSSKSTSGGTAALGCLVKDYFPEPVTVSWNSGALTSGVHTFPAVLQ SSGLYSLSSVVTVPSSSLGTQTYICNVNHKPSNTKVDKKVEPKSCDKTHTCPPCPQVKLEE SGGGLVLPGESLRLSCEASGRTITTITMGWFRQAPGKERQFVASHSWTDNNPYYADSVKG RFIISRDNAGNRVYLQMHSLEPEDTAVYYCAATARRSFVGRQWYTEARQYDYWGQGTQV TVSSASTKGPSVFPLAPSSKSTSGGTAALGCLVKDYFPEPVTVSWNSGALTSGVHTFPAVL QSSGLYSLSSVVTVPSSSLGTQTYICNVNHKPSNTKVDKKVEPKSCDKTHTCPPCPAPELLG GPSVFLFPPKPKDTLMISRTPEVTCVVVDVSHEDPEVKFNWYVDGVEVHNAKTKPREEQY NSTYRVVSVLTVLHQDWLNGKEYKCKVSNKALPAPIEKTISKAKGQPREPQVYTLPPSRDE LTKNQVSLTCLVKGFYPSDIAVEWESNGQPENNYKTTPPVLDSDGSFFLYSKLTVDKSRW QQGNVFSCSVMHEALHNHYTQKSLSLSPGK |
| | 362 | (light chain fusion polypeptide; linker peptide is bolded; anti-CTLA-4 sdAb is underlined) EIVLTQSPATLSLSPGERATLSCRASKGVSTSGYSYLHWYQQKPGQAPRLLIYLASYLESGV PARFSGSGSGTDFTLTISSLEPEDFAVYYCQHSRDLPLTFGGGTKVEIKRTVAAPSVFIFPPSD EQLKSGTASVVCLLNNFYPREAKVQWKVDNALQSGNSQESVTEQDSKDSTYSLSSTLTLS KADYEKHKVYACEVTHQGLSSPVTKSFNRGECEPKSCDKTHTCPPCPQVKLEESGGGLV LPGESLRLSCEASGRTITTITMGWFRQAPGKERQFVASHSWTDNNPYYADSVKGRFIISRDN AGNRVYLQMHSLEPEDTAVYYCAATARRSFVGRQWYTEARQYDYWGQGTQVTVSSRTV AAPSVFIFPPSDEQLKSGTASVVCLLNNFYPREAKVQWKVDNALQSGNSQESVTEQDSKDS TYSLSSTLTLSKADYEKHKVYACEVTHQGLSSPVTKSFNRGEC |
| BCP-36 (Keytruda-scFv-hIgG1 hinge-A34311-$C_H$1-IgG1 Fc, A34311-$C_L$ as light chain fusion polypeptide) | 363 | (heavy chain fusion polypeptide; linker peptide is bolded; anti-CTLA-4 sdAb is underlined) EIVLTQSPATLSLSPGERATLSCRASKGVSTSGYSYLHWYQQKPGQAPRLLIYLASYLESGV PARFSGSGSGTDFTLTISSLEPEDFAVYYCQHSRDLPLTFGGGTKVEIKGGGGSGGGGSGG GGSQVQLVQSGVEVKKPGASVKVSCKASGYTFTNYYMYWVRQAPGQGLEWMGGINPSN GGTNFNEKFKNRVTLTTDSSTTTAYMELKSLQFDDTAVYYCARRDYRFDMGFDYWGQGT TVTVSSEPKSCDKTHTCPPCPQVKLEESGGGLVLPGESLRLSCEASGRTITTITMGWFRQA PGKERQFVASHSWTDNNPYYADSVKGRFIISRDNAGNRVYLQMHSLEPEDTAVYYCAAT ARRSFVGRQWYTEARQYDYWGQGTQVTVSSASTKGPSVFPLAPSSKSTSGGTAALGCLVK DYFPEPVTVSWNSGALTSGVHTFPAVLQSSGLYSLSSVVTVPSSSLGTQTYICNVNHKPSNT KVDKKVEPKSCDKTHTCPPCPAPELLGGPSVFLFPPKPKDTLMISRTPEVTCVVVDVSHEDP EVKFNWYVDGVEVHNAKTKPREEQYNSTYRVVSVLTVLHQDWLNGKEYKCKVSNKALP APIEKTISKAKGQPREPQVYTLPPSRDELTKNQVSLTCLVKGFYPSDIAVEWESNGQPENNY KTTPPVLDSDGSFFLYSKLTVDKSRWQQGNVFSCSVMHEALHNHYTQKSLSLSPGK |
| | 364 | (light chain fusion polypeptide; anti-CTLA-4 sdAb is underlined) QVKLEESGGGLVLPGESLRLSCEASGRTITTITMGWFRQAPGKERQFVASHSWTDNNPYY ADSVKGRFIISRDNAGNRVYLQMHSLEPEDTAVYYCAATARRSFVGRQWYTEARQYDYW GQGTQVTVSSRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSFNRGEC |

SEQ ID NO: 365 (linker peptide amino acid sequence)
GGGGSGGGGSGGGGS

SEQ ID NO: 366 (AS07014 direct grafted HCAb dimeric form amino acid sequence)
EVQLVESGGGLVQPGGSLRLSCAASGYTYSRHCLGWVRQAPGKGLEWVSTIDSDGSTSYADSVKGRFTISR
DNSKNTLYLQMNSLRAEDTAVYYCARGPNPRYCSGAPNTRGAEHYFDYWGQGTLVTVSSEPKSCDKTHT
CPPCPAPELLGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEKTISKAKGQPREPQVYTLPPSRDELTKNQVSLTC
LVKGFYPSDIAVEWESNGQPENNYKTTPPVLDSDGSFFLYSKLTVDKSRWQQGNVFSCSVMHEALHNHYT
QKSLSLSPGK SEQ ID NO: 367 (AS07189 direct grafted HCAb dimeric form amino acid sequence)
EVQLVESGGGLVQPGGSLRLSCAASGFSPSVNYMGWVRQAPGKGLEWVSSIYPTGGTFYTDSVKGRFTISR
DNSKNTLYLQMNSLRAEDTAVYYCARGKWGTDYWGQGTLVTVSSEPKSCDKTHTCPPCPAPELLGGPSV
FLFPPKPKDTLMISRTPEVTCVVVDVSHEDPEVKFNWYVDGVEVHNAKTKPREEQYNSTYRVVSVLTVLH
QDWLNGKEYKCKVSNKALPAPIEKTISKAKGQPREPQVYTLPPSRDELTKNQVSLTCLVKGFYPSDIAVEW
ESNGQPENNYKTTPPVLDSDGSFFLYSKLTVDKSRWQQGNVFSCSVMHEALHNHYTQKSLSLSPGK TABLE 9-continued Anti-CTLA-4/PD-1 bispecific antibody sequences

| Construct name and description | SEQ ID NO | Amino acid sequence |
|---|---|---|

SEQ ID NO: 368 (AS07189TKDVH21FY HCAb dimeric form amino acid sequence)
EVQLVESGGGLVQPGGSLRLSCAASGFSPSVNYMGWVRQAPGKGLEEVSSIYPTGGTFYTDSVKGRFTISR
DNSKNTLYLQMNSLRAEDTAVYYCAAGKYGTDYWGQGTLVTVSSEPKSCDKTHTCPPCPAPELLGGPSVF
LFPPKPKDTLMISRTPEVTCVVVDVSHEDPEVKFNWYVDGVEVHNAKTKPREEQYNSTYRVVSVLTVLHQ
DWLNGKEYKCKVSNKALPAPIEKTISKAKGQPREPQVYTLPPSRDELTKNQVSLTCLVKGFYPSDIAVEWE
SNGQPENNYKTTPPVLDSDGSFFLYSKLTVDKSRWQQGNVFSCSVMHEALHNHYTQKSLSLSPGK SEQ ID NO: 369 (A34311VH2 HCAb dimeric form amino acid sequence)
EVQLVESGGGVVQPGRSLRLSCAASGRTITTITMGWFRQAPGKGLEFVASHSWTDNNPYYADSVKGRFTIS
RDNSKNTLYLQMNSLRAEDTAVYYCAATARRSFVGRQWYTEARQYDYWGQGTLVTVSSEPKSCDKTHT
CPPCPAPELLGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEKTISKAKGQPREPQVYTLPPSRDELTKNQVSLTC
LVKGFYPSDIAVEWESNGQPENNYKTTPPVLDSDGSFFLYSKLTVDKSRWQQGNVFSCSVMHEALHNHYT
QKSLSLSPGK SEQ ID NO: 370 (A34311VH2F53 HCAb dimeric form amino acid sequence)
EVQLVESGGGVVQPGRSLRLSCAASGRTITTITMGWFRQAPGKGLEFVASHSFTDNNPYYADSVKGRFTIS
RDNSKNTLYLQMNSLRAEDTAVYYCAATARRSFVGRQWYTEARQYDYWGQGTLVTVSSEPKSCDKTHT
CPPCPAPELLGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEKTISKAKGQPREPQVYTLPPSRDELTKNQVSLTC
LVKGFYPSDIAVEWESNGQPENNYKTTPPVLDSDGSFFLYSKLTVDKSRWQQGNVFSCSVMHEALHNHYT
QKSLSLSPGK SEQ ID NO: 371 (A34311VH11F53 HCAb dimeric form amino acid sequence)
EVQLVESGGGVVQPGRSLRLSCAASGRTITTITMGWFRQAPGKGREFVASHSFTDNNPYYADSVKGRFTIS
RDNAKNTLYLQMNSLRPEDTAVYYCAATARRSFVGRQWYTEARQYDYWGQGTLVTVSSEPKSCDKTHT
CPPCPAPELLGGPSVFLFPPKPKDTLMISRTPEVTCVVVDVSHEDPEVKFNWYVDGVEVHNAKTKPREEQY
NSTYRVVSVLTVLHQDWLNGKEYKCKVSNKALPAPIEKTISKAKGQPREPQVYTLPPSRDELTKNQVSLTC
LVKGFYPSDIAVEWESNGQPENNYKTTPPVLDSDGSFFLYSKLTVDKSRWQQGNVFSCSVMHEALHNHYT
QKSLSLSPGK SEQ ID NO: 372 (A34311 consensus amino acid sequence)
EVQLVESGGGVVQPGRSLRLSCAASGRTITTITMGWFRQAPGKGLEFVASHSWTDNNPYYADSVKGRFTIS
RDNSKNTLYLQMNSLRAEDTAVYYCAATARRSFVGRQWYTEARQYDYWGQGTLVTVSS SEQ ID NO: 373 (AS07014 consensus amino acid sequence)
EVQLVESGGGLVQPGGSLRLSCAASGYTYSRHCLGWFRQAPGKGREAVSTIDSGGSTSYADSVKGRFTISR
DNAKNTLYLQMNSLRPEDTAVYYCAIGPNPRYCSGAPNTRGAEHYFGYWGQGTLVTVSS SEQ ID NO: 374 (AS07189 consensus amino acid sequence)
EVQLVESGGGLVQPGGSLRLSCAASGFSPSVNYMGWFRQAPGKGREEVSSIYPTGGTFYTDSVKGRFTISR
DNAKNTLYLQMNSLRPEDTAVYYCAAGKWGTDYWGQGTLVTVSS SEQ ID NO: 375 (linker amino acid sequence, n is an integer of at least one)
$(G)_n$ SEQ ID NO: 376 (linker amino acid sequence, n is an integer of at least one)
$(GS)_n$ SEQ ID NO: 377 (linker amino acid sequence, n is an integer of at least one)
$(GSGGS)_n$ SEQ ID NO: 378 (linker amino acid sequence, n is an integer of at least one)
$(GGGS)_n$ SEQ ID NO: 379 (linker amino acid sequence, n is an integer of at least one)
$(GGGGS)_n$

SEQUENCE LISTING (379 sequences)

SEQ ID NO: 1 - protein, 25 aa, Artificial Sequence
  A34310 FR1
QVQLVESGGGLVQAGGSLRLSCAAS

SEQ ID NO: 2 - protein, 25 aa, Artificial Sequence
  A34311 FR1
QVKLEESGGGLVLPGESLRLSCEAS

SEQ ID NO: 3 - protein, 25 aa, Artificial Sequence
  A34313 FR1
QVQLVESGGGLVQAGGSLRLSCATS

SEQ ID NO: 4 - protein, 25 aa, Artificial Sequence
  A34625 FR1
QVKLEESGGGLVQPGGSLRLSCVAS

SEQ ID NO: 5 - protein, 25 aa, Artificial Sequence
  A36566 FR1
EVQLVESGGGLVQVGDSLRLSCAAS

SEQ ID NO: 6 - protein, 25 aa, Artificial Sequence
  A36922 FR1
QVQLVESGGGLVQAGGSLRLSCAAS

SEQ ID NO: 7 - protein, 25 aa, Artificial Sequence
  A37067 FR1
AVQLVDSGGGLVQAGGSLRLSCAAS

SEQ ID NO: 8 - protein, 25 aa, Artificial Sequence
  AS07014 FR1
QVHLVESGGGSVQAGGSLRLSCAAS

SEQ ID NO: 9 - protein, 25 aa, Artificial Sequence
  AS07172 FR1
QVKLVESGGGSVQAGGSLRLSCAVS

SEQ ID NO: 10 - protein, 25 aa, Artificial Sequence
  AS07189 FR1
QVQLVESGGGSVQAGGSLRLSCAAS

SEQ ID NO: 11 - protein, 25 aa, Artificial Sequence
  AS07392 FR1
QVKLVESGGGSVQAGGSLRLSCAAS

SEQ ID NO: 12 - protein, 25 aa, Artificial Sequence
  AS07678 FR1
QVHLMESGGGSVQAGGSLRLSCAAS

SEQ ID NO: 13 - protein, 25 aa, Artificial Sequence
  AS07688 FR1
QIQLVESGGGSVQAGGSLRLSCAAS

SEQ ID NO: 14 - protein, 25 aa, Artificial Sequence
  AS07712 FR1
QIQLVESGGGSVQAGGSLRLSCAAS

SEQ ID NO: 15 - protein, 25 aa, Artificial Sequence
  AS07745 FR1
QMQLVESGGGLVQPGGSLRLSCAAS

SEQ ID NO: 16 - protein, 25 aa, Artificial Sequence
  AS07832 FR1
QVQLVESGGGSVQAGGSLRLSCAAS

SEQ ID NO: 17 - protein, 10 aa, Artificial Sequence
  A34310 CDR1
GFTFDDYAIG

SEQ ID NO: 18 - protein, 10 aa, Artificial Sequence
  A34311 CDR1
GRTITTITMG

SEQ ID NO: 19 - protein, 11 aa, Artificial Sequence
  A34313 CDR1
VRTPLSNFAMG

SEQ ID NO: 20 - protein, 10 aa, Artificial Sequence
  A34625 CDR1
GSIDSTYTMG

SEQ ID NO: 21 - protein, 10 aa, Artificial Sequence
  A36566 CDR1
GRSFENYAIG

SEQ ID NO: 22 - protein, 10 aa, Artificial Sequence
  A36922 CDR1
GRLSRTFTMG

SEQ ID NO: 23 - protein, 10 aa, Artificial Sequence
  A37067 CDR1
GSISSLNAMA

SEQ ID NO: 24 - protein, 10 aa, Artificial Sequence
  AS07014 CDR1
GYTYSRHCLG

SEQ ID NO: 25 - protein, 10 aa, Artificial Sequence
  AS07172 CDR1
GDDLSNYCMG

SEQ ID NO: 26 - protein, 10 aa, Artificial Sequence
  AS07189 CDR1
GDSPSVNYMG

SEQ ID NO: 27 - protein, 10 aa, Artificial Sequence
  AS07392 CDR1
GDSYSVKYMG

SEQ ID NO: 28 - protein, 10 aa, Artificial Sequence
  AS07678 CDR1
GYTYSRYCLG

SEQ ID NO: 29 - protein, 10 aa, Artificial Sequence
  AS07688 CDR1
GDSYSVNYMG

SEQ ID NO: 30 - protein, 10 aa, Artificial Sequence
  AS07712 CDR1
AYTDRRYCMA

SEQ ID NO: 31 - protein, 10 aa, Artificial Sequence
  AS07745 CDR1
GFTFSSYYMS

SEQ ID NO: 32 - protein, 9 aa, Artificial Sequence
  AS07832 CDR1
GYYNRYCLG

SEQ ID NO: 33 - protein, 14 aa, Artificial Sequence
  A34310 FR2
WFRQAPGKEREGVS

SEQ ID NO: 34 - protein, 14 aa, Artificial Sequence
  A34311 FR2
WFRQAPGKERQFVA

SEQ ID NO: 35 - protein, 14 aa, Artificial Sequence
  A34313 FR2
WFRQTPGKEREFVA

SEQ ID NO: 36 - protein, 14 aa, Artificial Sequence
  A34625 FR2
WYRQAPGKQRELVA

SEQ ID NO: 37 - protein, 14 aa, Artificial Sequence
  A36566 FR2
WFRQAPGKEREFVA

SEQ ID NO: 38 - protein, 14 aa, Artificial Sequence
  A36922 FR2
WYRQAPGKQRDLVA

SEQ ID NO: 39 - protein, 14 aa, Artificial Sequence
  A37067 FR2
WYRQGPGKERELVA

SEQ ID NO: 40 - protein, 14 aa, Artificial Sequence
  AS07014 FR2
WFRQTPGKEREAVA

SEQ ID NO: 41 - protein, 14 aa, Artificial Sequence
  AS07172 FR2
WVRQAPGKEREEVA

SEQ ID NO: 42 - protein, 17 aa, Artificial Sequence
  AS07189 FR2
WFRRAPEKQREQREEVA

SEQ ID NO: 43 - protein, 17 aa, Artificial Sequence
  AS07392 FR2
WFRRAPGKQRDQREEVA

SEQ ID NO: 44 - protein, 14 aa, Artificial Sequence
  AS07678 FR2
WFRQTPGKEREAVA

SEQ ID NO: 45 - protein, 17 aa, Artificial Sequence
  AS07688 FR2
WFRRAPGQQREQREEVA

SEQ ID NO: 46 - protein, 14 aa, Artificial Sequence
  AS07712 FR2
WFRQAPGKEREGVA

SEQ ID NO: 47 - protein, 14 aa, Artificial Sequence
  AS07745 FR2
WVRQAPGKGLEWVS

SEQ ID NO: 48 - protein, 14 aa, Artificial Sequence
  AS07832 FR2
WFRQTPGKEREAVA

SEQ ID NO: 49 - protein, 15 aa, Artificial Sequence
  A34310 CDR2
CISSGGTYYADSVKG

SEQ ID NO: 50 - protein, 17 aa, Artificial Sequence
  A34311 CDR2
SHSWTDNNPYYADSVKG

SEQ ID NO: 51 - protein, 17 aa, Artificial Sequence
  A34313 CDR2
AISRSGGSTSYADSVKG

SEQ ID NO: 52 - protein, 16 aa, Artificial Sequence
  A34625 CDR2
SITSSGSTNHADSVKG

SEQ ID NO: 53 - protein, 21 aa, Artificial Sequence
  A36566 CDR2
TISWIPRTAYSTTYYADSVKG

SEQ ID NO: 54 - protein, 16 aa, Artificial Sequence
  A36922 CDR2
SITTSGSTNYADSVKG

SEQ ID NO: 55 - protein, 16 aa, Artificial Sequence
  A37067 CDR2
SITRGGSTAYTDSVKG

SEQ ID NO: 56 - protein, 16 aa, Artificial Sequence
  AS07014 CDR2
TIDSDGSTSYADSVKG

SEQ ID NO: 57 - protein, 16 aa, Artificial Sequence
  AS07172 CDR2
TIDYAFKTNYADSVKG

SEQ ID NO: 58 - protein, 16 aa, Artificial Sequence
  AS07189 CDR2
SIYPTGGTFYTDSVKG

SEQ ID NO: 59 - protein, 16 aa, Artificial Sequence
  AS07392 CDR2
SIYPTGGTFYTDSVKG

SEQ ID NO: 60 - protein, 16 aa, Artificial Sequence
  AS07678 CDR2
TIDIDGSTSYADSVKG

SEQ ID NO: 61 - protein, 16 aa, Artificial Sequence
  AS07688 CDR2
SIYATGGTFYRDSVKG

SEQ ID NO: 62 - protein, 16 aa, Artificial Sequence
  AS07712 CDR2
TMDTDGSTRYADSVKG

SEQ ID NO: 63 - protein, 17 aa, Artificial Sequence
  AS07745 CDR2
SIYSDGSNTYYADSVKG

SEQ ID NO: 64 - protein, 16 aa, Artificial Sequence
  AS07832 CDR2
TIDTDGSTSYADSVKG

SEQ ID NO: 65 - protein, 32 aa, Artificial Sequence
  A34310 FR3
RFTISSDNAKNTVFLQMNSLKPEDTAVYYCGA

SEQ ID NO: 66 - protein, 32 aa, Artificial Sequence
  A34311 FR3
RFIISRDNAGNRVYLQMHSLEPEDTAVYYCAA

SEQ ID NO: 67 - protein, 32 aa, Artificial Sequence
  A34313 FR3
RFTISRDNAKNTVYLEMNSLKGEDTVVYYCAA

SEQ ID NO: 68 - protein, 32 aa, Artificial Sequence
  A34625 FR3
RFTISRDNAKNTVYLQMNTLKPEDAAVYYCRY

SEQ ID NO: 69 - protein, 32 aa, Artificial Sequence
  A36566 FR3
RFTISGDNSKNTVYLQMTSLKPEDTAVYYCAA

SEQ ID NO: 70 - protein, 32 aa, Artificial Sequence
  A36922 FR3
RFTISRDNAKNTVILQMNSLVPEDTAVYYCRF

SEQ ID NO: 71 - protein, 32 aa, Artificial Sequence
  A37067 FR3
RFTISRDNAKNTVYLQMNSLKPEDTAVYYCRA

SEQ ID NO: 72 - protein, 32 aa, Artificial Sequence
  AS07014 FR3
RFTISSDNAKNTLYLQMNSLKPEDTAMYYCAI

SEQ ID NO: 73 - protein, 34 aa, Artificial Sequence
  AS07172 FR3
RFTISKDNAENSLRVNLEMNDLKPDDTAMYYCAA

SEQ ID NO: 74 - protein, 32 aa, Artificial Sequence
  AS07189 FR3
RFTISRDNAKNTLYLQMTALKPEDTAMYYCAA

SEQ ID NO: 75 - protein, 32 aa, Artificial Sequence
  AS07392 FR3
RFTISRDNAKSTLYLQMTALKPEDTAMYYCAA

SEQ ID NO: 76 - protein, 32 aa, Artificial Sequence
  AS07678 FR3
RFTISNDNAKNTLYLQMNILKPEDTAMYYCAA

SEQ ID NO: 77 - protein, 32 aa, Artificial Sequence; identical to SEQ ID NO: 74
  AS07688 FR3

SEQ ID NO: 78 - protein, 32 aa, Artificial Sequence
  AS07712 FR3
RFTISTDSAKNTLYLQMNSLEPEDTAMYYCAV

SEQ ID NO: 79 - protein, 32 aa, Artificial Sequence
  AS07745 FR3
RFTISRDNAKNTVYLQMNSLKSEDTALYYCAT

SEQ ID NO: 80 - protein, 32 aa, Artificial Sequence
  AS07832 FR3
RFTISFDNAKNTLYLQMNSLKPEDTAMYYCAA

SEQ ID NO: 81 - protein, 26 aa, Artificial Sequence
  A34310 CDR3
VSSLLSVERFPGGHCGPRYGYYRHGY

SEQ ID NO: 82 - protein, 20 aa, Artificial Sequence
  A34311 CDR3
TARRSFVGRQWYTEARQYDY

SEQ ID NO: 83 - protein, 18 aa, Artificial Sequence
  A34313 CDR3
KIAGMNNIVFIGAPQYNY

SEQ ID NO: 84 - protein, 7 aa, Artificial Sequence
  A34625 CDR3
LSVLSAY

SEQ ID NO: 85 - protein, 15 aa, Artificial Sequence
  A36566 CDR3
GGATGPLALDSHYGY

SEQ ID NO: 86 - protein, 7 aa, Artificial Sequence
  A36922 CDR3
LSASTAA

SEQ ID NO: 87 - protein, 9 aa, Artificial Sequence
  A37067 CDR3
VWGFGDYGS

SEQ ID NO: 88 - protein, 22 aa, Artificial Sequence
  AS07014 CDR3
GPNPRYCSGAPNTRGAEHYFGY

SEQ ID NO: 89 - protein, 16 aa, Artificial Sequence
  AS07172 CDR3
DWSSGGVCFGLADFGT

SEQ ID NO: 90 - protein, 7 aa, Artificial Sequence
  AS07189 CDR3
GKWGTDY

SEQ ID NO: 91 - protein, 7 aa, Artificial Sequence
  AS07392 CDR3
GKWGTDY

SEQ ID NO: 92 - protein, 22 aa, Artificial Sequence
  AS07678 CDR3
GPNPRYCSGAVYTRGAEHYFGY

SEQ ID NO: 93 - protein, 7 aa, Artificial Sequence
  AS07688 CDR3
GKWGTDY

SEQ ID NO: 94 - protein, 22 aa, Artificial Sequence
  AS07712 CDR3
GPNPRYCSGAINTRGAEHYFGY

SEQ ID NO: 95 - protein, 17 aa, Artificial Sequence
  AS07745 CDR3
PRGAHGPTYCSGGYCYY

SEQ ID NO: 96 - protein, 22 aa, Artificial Sequence
  AS07832 CDR3
GPNPRYCSGAVNTRGAEHYFGY

SEQ ID NO: 97 - DNA, 399 bp, Artificial Sequence
  A34310 sdAb
caggtacagctggtggagtctgggggaggcttggtgcaggctggggggtctctgagactctcctgtgcagcctctggattcactttcgatgattatgccataggctggttccgccaggccccagggaaggagcgtgagggggtctcatgtattagtagtggtggcacatactatgcagactccgtgaagggccgattcaccatctccagtgacaacgccaagaacacggtgtttctgcaaatgaacagcctgaaacctgaggacacggctgtttattactgtggagcagtttcgtcgctcttaagtgtggagaggttccctggaggtcattgcggcccccgttatgggtactaccgtcacggctactggggccaggggacccaggtcaccgtctcctca

SEQ ID NO: 98 - DNA, 387 bp, Artificial Sequence
  A34311 sdAb
caggtaaagctggaggagtctgggggaggcttggtgctgcctggggagtctctgagactctcctgtgaagcctctggtcgcaccatcacaacgattactatgggctggttccgccaggctccagggaaggagcgtcagtttgtagcgtctcatagttggactgataataacccatactatgcagactccgttaagggccgattcatcatctccagagacaacgccgggaacagggtatatctgcagatgcatagcctggaacctgaggacacggccgtttattactgcgcagcaaccgctagaagatcattcgtgggtagacagtggtacactgaagcacgccagtatgactactggggccaggggacccaggtcaccgtctcctca

SEQ ID NO: 99 - DNA, 384 bp, Artificial Sequence
  A34313 sdAb
caggtacagctggtggagtctgggggaggattggtgcaggctgggggctctctgagactctcctgtgcaacctctgtacgcacccccctcagtaactttgccatgggctggttccgccagactccagggaaagagcgtgagtttgtagcagcaattagcaggagtggtggaagcacatcgtatgcagactccgtgaagggccgattcaccatctccagggacaacgccaagaacacggtgtatctcgaaatgaacagcctgaaaggcgaggacacggtcgtttattactgtgcagccaaaatagcggggatgaataatattgtctttatcggcgcgccccagtataactactggggccaggggacccaggtcaccgtctcctca

SEQ ID NO: 100 - DNA, 345 bp, Artificial Sequence
  A34625 sdAb
caggtaaagctggaggagtctgggggaggcttggtgcagcctggggggtctctgagactctcctgtgtagcgtctggaagcatcgacagcacctataccatgggctggtaccgccaggctccagggaaacagcgcgagttggtcgcttctattactagttctggtagcacaaaccatgcagactccgtgaagggccgattcacaatctccagagacaacgccaagaacacggtgtatcttcaaatgaacaccctgaaacccgaggacgcggccgtctattactgtagatacctaagtgtgcttagtgcctactggggccaggggacccaggtcaccgtctcctca

SEQ ID NO: 101 - DNA, 384 bp, Artificial Sequence
  A36566 sdAb
gaggtgcagctggtggagtctgggggaggattggtgcaggttggggactctctgagactctcctgtgcagcctctggacgctcgttcgagaactatgccataggctggttccgccaggctccaggcaaggagcgtgagtttgtagcaacaatttcgtggattcctcgtaccgcatactctaccacatactatgcagactccgtgaagggcagattcaccatctctggagacaacagcaagaacacggtgtatctgcaaatgacgagcctgaaacctgaggacacggccgtttattactgtgcagcaggcggggcgacaggaccgttggcgttggactcccactatgggtactggggccaggggacccaggtcaccgtctcctca

SEQ ID NO: 102 - DNA, 345 bp, Artificial Sequence
  A36922 sdAb
caggtacagctggtggagtctgggggaggcttggtgcaggctggggggtcgctgagactctcctgtgcagcctctggtcgcctcagtaggacgtttaccatgggctggtaccgccaggctccagggaagcagcgcgacttggtcgcgtctattactacaagtggtagcacgaactatgcagactccgtgaagggccgattcaccatctccagagacaacgccaaaaacacggtgattctgcaaatgaacagcctggtacctgaggacacagccgtctattactgccgttttcttagcgcaagtactgcagcctggggccaggggacccaggtcaccatctccacg

SEQ ID NO: 103 - DNA, 351 bp, Artificial Sequence
  A37067 sdAb
gccgtgcagctggtggattctgggggaggcttggtgcaggctggggggtcgctgagactctcctgtgcagcctctggaagcatcagcagtctcaacgccatggcatggtaccgccagggtccagggaaggagcgcgagctggtcgcaagtattactaggggtggtagtacagcctatacagactccgtgaagggccgattcaccatctccagagacaacgccaagaacacggtgtatctgcaaatgaacagcctgaaacctgaggacacagccgtctattactgtagagcggtttggggttttggggattatggttcctggggccaggggacccaggtcaccgtctcttcg

SEQ ID NO: 104 - DNA, 390 bp, Artificial Sequence
  AS07014 sdAb
caggtgcacctggtggagtctgggggaggctcggtgcaggctggagggtctctgagactctcctgtgcagcctctggatacacctacagtagacactgcctgggctggttccgccagactccagggaaggagcgcgaggcggtcgcgactattgatagtgatggtagcacaagctacgcagactccgtgaagggccgattcaccatctccagtgacaacgccaagaacactctatatctgcaaatgaacagcctgaaacctgaggacactgccatgtactactgtgcgatagggccgaacccgcgatattgtagtggcgcgcccaacactcggggcgccgaacactactttggttactgggcccaggggacccaggtcaccgtctcctca

SEQ ID NO: 105 - DNA, 378 bp, Artificial Sequence
  AS07172 sdAb
caggtgaagttagtggagtctgggggaggctcggtgcaggctggagggtctctaagactttcctgtgcagtgtctggagacgatttgagtaactactgcatgggctgggtccgccaggctccagggaaggagcgcgaagaggtcgcaactattgattatgcctttaagacaaattacgcagactccgtgaagggccggttcaccatctccaaagacaacgccgagaatagtctacgcgtaaatttggaaatgaacgacctgaaacctgacgacactgccatgtactattgtgcggcagattggagtagtggtggtgtgtgttttggattagcggactttggtacccggggccaggggacccaggtcaccgtctcctca

SEQ ID NO: 106 - DNA, 354 bp, Artificial Sequence
  AS07189 sdAb
caggtgcagctggtggagtctgggggaggctcggtgcaggctggagggtctctgagactctcctgtgcagcctctggagacagtcctagtgtgaactacatgggctggttccgccgggctccagaaaaacagcgcgagcagcgcgaggaggtcgcaagtatttatcccacaggtggcacgttttacacagactccgtgaagggccgattcaccatctcccgagacaacgccaagaacactctgtatctccaaatgaccgccctgaaacctgaggatactgccatgtactactgtgcggcaggaaaatgggggactgactactggggccaggggacccaggtcatcgtctcctca

SEQ ID NO: 107 - DNA, 354 bp, Artificial Sequence
  AS07392 sdAb
caggtgaagttggtggagtctgggggaggctcggtgcaggctggagggtctctgagactctcctgtgcagcctctggagacagttatagtgtgaagtacatgggctggttccgccgggctccagggaaacagcgcgaccagcgcgaggaggtcgcaagtatttatcccacaggtggcacgttttacacagactccgtgaagggccgattcaccatctcccgagacaacgccaagagcactctgtatctccaaatgaccgccctgaaacctgaggatactgccatgtactactgtgcggcaggcaaatgggggactgactactggggccaggggacccaggtcaccgtctcctca

SEQ ID NO: 108 - DNA, 390 bp, Artificial Sequence
  AS07678 sdAb
caggtgcacctgatggagtctgggggaggctcggtgcaggctggagggtctctgagactctcctgtgcagcctctggatacacctacagtaggtactgcctgggctggttccgccagactccagggaaggagcgcgaggcggtcgcaactattgatattgatggtagcacaagctacgcagactccgtgaagggccgattcaccatctccaatgacaacgccaagaacactctatatctgcaaatgaacatcctgaaacctgaggacactgccatgtactactgtgcggcagggccgaacccgcgatattgtagtggcgcagtctacactcggggcgccgaacactactttggttactggggccaggggacccaggtcaccgtctcctca

SEQ ID NO: 109 - DNA, 354 bp, Artificial Sequence
  AS07688 sdAb
cagattcagctggtggagtctgggggaggctcggtgcaggctggagggtctctgagactctcctgtgcagcctctggagacagttatagtgtgaactacatgggctggttccgccgggctccagggcaacagcgcgagcagcgcgaggaggtcgcaagtatttatgccacgggtggcacgttttacagagactccgtgaagggccgattcaccatctcccgagacaacgccaagaacactctgtatctccaaatgaccgccctgaaacctgaggatactgccatgtactactgtgcggcaggcaaatgggggactgactactggggccaggggacccaggtcatcgtctcctca

SEQ ID NO: 110 - DNA, 390 bp, Artificial Sequence
  AS07712 sdAb
cagattcagctggtggagtctgggggaggctcggtgcaggctggagggtctctgagactctcctgtgcagcctctgcatacaccgacagacgctactgcatggcctggttccgccaggctccagggaaggagcgcgagggggtcgcaactatggatactgatggtagtacaaggtacgcagactccgtgaagggccgattcaccatctccacagacagcgccaagaacactctgtatctgcaaatgaacagcctggaacctgaggacactgccatgtactactgtgcggtggggccgaacccgcgatattgtagtggcgcaatcaacactcggggcgccgaacactactttggttactggggccaggggacccaggtcaccgtctcctca

SEQ ID NO: 111 - DNA, 378 bp, Artificial Sequence
  AS07745 sdAb
cagatgcagctggtggagtctgggggaggcttggtgcagcctggggggtctctgagactctcctgtgcagcctctggattcaccttcagtagctactacatgagctgggtccgccaggctccagggaaggggctggagtgggtgtccagtatttatagtgatggtagtaacacatactatgcagactccgtgaagggccgattcaccatctccagagacaacgccaagaacacggtgtatctgcaaatgaacagcctgaaatctgaggacacggccctgtattactgtgccaccccaaggggtgctcacggacctacatattgtagtggtggttactgctactacgggggccaggggacccaggtcaccgtctcctca

SEQ ID NO: 112 - DNA, 387 bp, Artificial Sequence
  AS07832 sdAb
caggttcagctggtggagtctgggggaggctcggtgcaggctggagggtctctgagactctcctgtgcagcctctggatactacaataggtactgcctgggctggttccgccagactccagggaaggagcgcgaggcggtcgcaactattgatacggatggtagcacaagctacgcagactccgtgaagggccgattcaccatctcctttgacaacgccaagaacactctatatctgcaaatgaacagcctgaaacctgaggacactgccatgtactactgtgcggcagggccgaacccgcgatattgtagtggcgcggtcaacactcggggcgccgaacactactttggttactgggcccaggggacccaggtcaccgtctcctca

SEQ ID NO: 113 - protein, 133 aa, Artificial Sequence
  A34310 sdAb
QVQLVESGGGLVQAGGSLRLSCAASGFTFDDYAIGWFRQAPGKEREGVSCISSGGTYYADSVKGRFTISSDNAKNTVFLQMNSLKPEDTAVYYCGAVSSLLSVERFPGGHCGPRYGYYRHGYWGQGTQVTVSS

SEQ ID NO: 114 - protein, 129 aa, Artificial Sequence
  A34311 sdAb
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 115 - protein, 128 aa, Artificial Sequence
  A34313 sdAb
QVQLVESGGGLVQAGGSLRLSCATSVRTPLSNFAMGWFRQTPGKEREFVAAISRSGGSTSYADSVKGRFTISRDNAKNTVYLEMNSLKGEDTVVYYCAAKIAGMNNIVFIGAPQYNYWGQGTQVTVSS

SEQ ID NO: 116 - protein, 115 aa, Artificial Sequence
  A34625 sdAb
QVKLEESGGGLVQPGGSLRLSCVASGSIDSTYTMGWYRQAPGKQRELVASITSSGSTNHADSVKGRFTISRDNAKNTVYLQMNTLKPEDAAVYYCRYLSVLSAYWGQGTQVTVSS

SEQ ID NO: 117 - protein, 128 aa, Artificial Sequence
  A36566 sdAb
EVQLVESGGGLVQVGDSLRLSCAASGRSFENYAIGWFRQAPGKEREFVATISWIPRTAYSTTYYADSVKGRFTISGDNSKNTVYLQMTSLKPEDTAVYYCAAGGATGPLALDSHYGYWGQGTQVTVSS

SEQ ID NO: 118 - protein, 115 aa, Artificial Sequence
  A36922 sdAb
QVQLVESGGGLVQAGGSLRLSCAASGRLSRTFTMGWYRQAPGKQRDLVASITTSGSTNYADSVKGRFTISRDNAKNTVILQMNSLVPEDTAVYYCRFLSASTAAWGQGTQVTIST

SEQ ID NO: 119 - protein, 117 aa, Artificial Sequence
  A37067 sdAb
AVQLVDSGGGLVQAGGSLRLSCAASGSISSLNAMAWYRQGPGKERELVASITRGGSTAYTDSVKGRFTISRDNAKNTVYLQMNSLKPEDTAVYYCRAVWGFGDYGSWGQGTQVTVSS

SEQ ID NO: 120 - protein, 130 aa, Artificial Sequence
  AS07014 sdAb
QVHLVESGGGSVQAGGSLRLSCAASGYTYSRHCLGWFRQTPGKEREAVATIDSDGSTSYADSVKGRFTISSDNAKNTLYLQMNSLKPEDTAMYYCAIGPNPRYCSGAPNTRGAEHYFGYWAQGTQVTVSS

SEQ ID NO: 121 - protein, 126 aa, Artificial Sequence
  AS07172 sdAb
QVKLVESGGGSVQAGGSLRLSCAVSGDDLSNYCMGWVRQAPGKEREEVATIDYAFKTNYADSVKGRFTISKDNAENSLRVNLEMNDLKPDDTAMYYCAADWSSGGVCFGLADFGTRGQGTQVTVSS

SEQ ID NO: 122 - protein, 118 aa, Artificial Sequence
  AS07189 sdAb
QVQLVESGGGSVQAGGSLRLSCAASGDSPSVNYMGWFRRAPEKQREQREEVASIYPTGGTFYTDSVKGRFTISRDNAKNTLYLQMTALKPEDTAMYYCAAGKWGTDYWGQGTQVIVSS

SEQ ID NO: 123 - protein, 118 aa, Artificial Sequence
  AS07392 sdAb
QVKLVESGGGSVQAGGSLRLSCAASGDSYSVKYMGWFRRAPGKQRDQREEVASIYPTGGTFYTDSVKGRFTISRDNAKSTLYLQMTALKPEDTAMYYCAAGKWGTDYWGQGTQVTVSS

SEQ ID NO: 124 - protein, 130 aa, Artificial Sequence
  AS07678 sdAb
QVHLMESGGGSVQAGGSLRLSCAASGYTYSRYCLGWFRQTPGKEREAVATIDIDGSTSYADSVKGRFTISNDNAKNTLYLQMNILKPEDTAMYYCAAGPNPRYCSGAVYTRGAEHYFGYWGQGTQVTVSS

SEQ ID NO: 125 - protein, 118 aa, Artificial Sequence
  AS07688 sdAb
QIQLVESGGGSVQAGGSLRLSCAASGDSYSVNYMGWFRRAPGQQREQREEVASIYATGGTFYRDSVKGRFTISRDNAKNTLYLQMTALKPEDTAMYYCAAGKWGTDYWGQGTQVIVSS

SEQ ID NO: 126 - protein, 130 aa, Artificial Sequence
  AS07712 sdAb
QIQLVESGGGSVQAGGSLRLSCAASAYTDRRYCMAWFRQAPGKEREGVATMDTDGSTRYADSVKGRFTISTDSAKNTLYLQMNSLEPEDTAMYYCAVGPNPRYCSGAINTRGAEHYFGYWGQGTQVTVSS

SEQ ID NO: 127 - protein, 126 aa, Artificial Sequence
  AS07745 sdAb
QMQLVESGGGLVQPGGSLRLSCAASGFTFSSYYMSWVRQAPGKGLEWVSSIYSDGSNTYYADSVKGRFTISRDNAKNTVYLQMNSLKSEDTALYYCATPRGAHGPTYCSGGYCYYGGQGTQVTVSS

SEQ ID NO: 128 - protein, 129 aa, Artificial Sequence
  AS07832 sdAb
QVQLVESGGGSVQAGGSLRLSCAASGYYNRYCLGWFRQTPGKEREAVATIDTDGSTSYADSVKGRFTISFDNAKNTLYLQMNSLKPEDTAMYYCAAGPNPRYCSGAVNTRGAEHYFGYWAQGTQVTVSS

SEQ ID NO: 129 - protein, 129 aa, Artificial Sequence
  AS02640 humanized sdAb
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 130 - protein, 361 aa, Artificial Sequence
  A34311 HCAb monomeric form
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 361 aa, Artificial Sequence
  A34311 HCAb dimeric form
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 361 aa, Artificial Sequence
  AS02640 HCAb monomeric form
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 133 - protein, 361 aa, Artificial Sequence
  AS02640 HCAb dimeric form
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - protein, 585 aa, Artificial Sequence
  BCP-2 (BCP-K311) heavy chain fusion polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSGGGSQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 135 - protein, 585 aa, Artificial Sequence
  BCP-311K heavy chain fusion polypeptide
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSGGGGSGGGSQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 136 - protein, 591 aa, Artificial Sequence
  Keytruda-hIgG1 hinge-A34311 heavy chain fusion sequence
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSCDKTHTCPPCPQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 137 - protein, 591 aa, Artificial Sequence
  A34311-hIgG1 hinge-Keytruda heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEPKSCDKTHTCPPCPQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 138 - protein, 576 aa, Artificial Sequence
  Keytruda-A34311 heavy chain fusion sequence
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 139 - protein, 576 aa, Artificial Sequence
  A34311-Keytruda heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 140 - protein, 585 aa, Artificial Sequence
  Keytruda-9GS-AS02640 heavy chain fusion sequence
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSGGGSQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 141 - protein, 585 aa, Artificial Sequence
  AS02640-9GS-Keytruda heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSGGGGSGGGSQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 142 - protein, 591 aa, Artificial Sequence
  Keytruda-hIgG1 hinge-AS02640 heavy chain fusion sequence
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSCDKTHTCPPCPQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 143 - protein, 591 aa, Artificial Sequence
  AS02640-hIgG1 hinge-Keytruda heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSEPKSCDKTHTCPPCPQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 144 - protein, 576 aa, Artificial Sequence
  Keytruda-AS02640 heavy chain fusion sequence
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 145 - protein, 576 aa, Artificial Sequence
  AS02640-Keytruda heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 146 - protein, 578 aa, Artificial Sequence
  Opdivo-9GS-A34311 heavy chain fusion sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSGGGSQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 147 - protein, 578 aa, Artificial Sequence
  A34311-9GS-Opdivo heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSGGGGSGGGSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 148 - protein, 584 aa, Artificial Sequence
  Opdivo-hIgG1 hinge-A34311 heavy chain fusion sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSCDKTHTCPPCPQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 149 - protein, 584 aa, Artificial Sequence
  A34311-hIgG1 hinge-Opdivo heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEPKSCDKTHTCPPCPQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 150 - protein, 569 aa, Artificial Sequence
  Opdivo-A34311 heavy chain fusion sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 151 - protein, 569 aa, Artificial Sequence
  A34311-Opdivo heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 152 - protein, 578 aa, Artificial Sequence
  Opdivo-9GS-AS02640 heavy chain fusion sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSGGGSQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 153 - protein, 578 aa, Artificial Sequence
  AS02640-9GS-Opdivo heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSGGGGSGGGSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 154 - protein, 584 aa, Artificial Sequence
  Opdivo-hIgG1 hinge-AS02640 heavy chain fusion sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSCDKTHTCPPCPQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 155 - protein, 584 aa, Artificial Sequence
  AS02640-hIgG1 hinge-Opdivo heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSEPKSCDKTHTCPPCPQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 156 - protein, 569 aa, Artificial Sequence
  Opdivo-AS02640 heavy chain fusion sequence
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 157 - protein, 569 aa, Artificial Sequence
  AS02640-Opdivo heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 158 - protein, 447 aa, Artificial Sequence
  Keytruda heavy chain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 159 - protein, 218 aa, Artificial Sequence
  Keytruda light chain amino acid sequence
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 160 - protein, 440 aa, Artificial Sequence
  Opdivo heavy chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 161 - protein, 214 aa, Artificial Sequence
  Opdivo light chain amino acid sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 162 - protein, 9 aa, Artificial Sequence
  Linker peptide
GGGGSGGGS

SEQ ID NO: 163 - protein, 15 aa, Artificial Sequence
  IgG1 hinge
EPKSCDKTHTCPPCP

SEQ ID NO: 164 - protein, 125 aa, Homo sapiens
AMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSD

SEQ ID NO: 165 - protein, 11 aa, Artificial Sequence
  A34310/A34311/A34313/A34625/A36566/A37067/ AS07392/AS07678/AS07712 FR4
WGQGTQVTVSS

SEQ ID NO: 166 - protein, 11 aa, Artificial Sequence
  A36922 FR4
WGQGTQVTIST

SEQ ID NO: 167 - protein, 11 aa, Artificial Sequence
  AS07014/AS07832 FR4
WAQGTQVTVSS

SEQ ID NO: 168 - protein, 11 aa, Artificial Sequence
  AS07172 FR4
RGQGTQVTVSS

SEQ ID NO: 169 - protein, 11 aa, Artificial Sequence
  AS07189/AS07688 FR4
WGQGTQVIVSS

SEQ ID NO: 170 - protein, 11 aa, Artificial Sequence
  AS07745 FR4
GGQGTQVTVSS

SEQ ID NO: 171 - protein, 586 aa, Artificial Sequence
  Tecentriq-9GS-A34311 heavy chain fusion sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 172 - protein, 586 aa, Artificial Sequence
  A34311-9GS-Tecentriq heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSGGGGSGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - protein, 592 aa, Artificial Sequence
  Tecentriq-hIgG1 hinge-A34311 heavy chain fusion sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKEPKSCDKTHTCPPCPQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 174 - protein, 592 aa, Artificial Sequence
  A34311-hIgG1 hinge-Tecentriq heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEPKSCDKTHTCPPCPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 175 - protein, 577 aa, Artificial Sequence
  Tecentriq-A34311 heavy chain fusion sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 176 - protein, 577 aa, Artificial Sequence
  A34311-Tecentriq heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 586 aa, Artificial Sequence
  Tecentriq-9GS-AS02640 heavy chain fusion sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 178 - protein, 586 aa, Artificial Sequence
  AS02640-9GS-Tecentriq heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSGGGGSGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 179 - protein, 592 aa, Artificial Sequence
  Tecentriq-hIgG1 hinge-AS02640 heavy chain fusion sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKEPKSCDKTHTCPPCPQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 180 - protein, 592 aa, Artificial Sequence
  AS02640-hIgG1 hinge-Tecentriq heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSEPKSCDKTHTCPPCPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 577 aa, Artificial Sequence
  Tecentriq-AS02640 heavy chain fusion sequence
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 182 - protein, 577 aa, Artificial Sequence
  AS02640-Tecentriq heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 589 aa, Artificial Sequence
  Durvalumab-9GS-A34311 heavy chain fusion sequence
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 184 - protein, 589 aa, Artificial Sequence
  A34311-9GS-Durvalumab heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSGGGGSGGGSEVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 595 aa, Artificial Sequence
  Durvalumab-hIgG1 hinge-A34311 heavy chain fusion sequence
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKEPKSCDKTHTCPPCPQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 186 - protein, 595 aa, Artificial Sequence
  A34311-hIgG1 hinge-Durvalumab heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEPKSCDKTHTCPPCPEVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 187 - protein, 580 aa, Artificial Sequence
  Durvalumab-A34311 heavy chain fusion sequence
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 188 - protein, 580 aa, Artificial Sequence
  A34311-Durvalumab heavy chain fusion sequence
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 189 - protein, 589 aa, Artificial Sequence
  Durvalumab-9GS-AS02640 heavy chain fusion sequence
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGSQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 190 - protein, 589 aa, Artificial Sequence
  AS02640-9GS-Durvalumab heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSGGGGSGGGSEVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 191 - protein, 595 aa, Artificial Sequence
  Durvalumab-hIgG1 hinge-AS02640 heavy chain fusion sequence
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKEPKSCDKTHTCPPCPQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 192 - protein, 595 aa, Artificial Sequence
  AS02640-hIgG1 hinge-Durvalumab heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSEPKSCDKTHTCPPCPEVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 193 - protein, 580 aa, Artificial Sequence
  Durvalumab-AS02640 heavy chain fusion sequence
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKQVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSS

SEQ ID NO: 194 - protein, 580 aa, Artificial Sequence
  AS02640-Durvalumab heavy chain fusion sequence
QVQLVESGGGVVQPGRSLRLSCAASGRTITTITMGWFRQAPGKGLEFVASHSWTDNNPYYADSVKGRFIISRDNSKNRLYLQMNSLRAEDTAVYYCAATARRSFVGRQWYTEARQYDYWGQGTLVTVSSEVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 195 - protein, 448 aa, Artificial Sequence
  Tecentriq heavy chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - protein, 214 aa, Artificial Sequence
  Tecentriq light chain amino acid sequence
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 197 - protein, 451 aa, Artificial Sequence
  Durvalumab heavy chain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - protein, 215 aa, Artificial Sequence
  Durvalumab light chain amino acid sequence
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 199 - protein, 187 aa, Homo sapiens
AMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 200 - protein, 129 aa, Artificial Sequence
  A34311-direct grafted amino acid
QVQLVESGGGVVQPGRSLRLSCAASGRTITTITMGWVRQAPGKGLEWVASHSWTDNNPYYADSVKGRFTISRDNSKNTLYLQMNSLRAEDTAVYYCAKTARRSFVGRQWYTEARQYDYWGQGTLVTVSS

SEQ ID NO: 201 - protein, 129 aa, Artificial Sequence
  AS02636 humanized sdAb
QVQLVESGGGVVQPGRSLRLSCAASGRTITTITMGWFRQAPGKGRQFVASHSWTDNNPYYADSVKGRFIISRDNSKNTLYLQMNSLRPEDTAVYYCAATARRSFVGRQWYTEARQYDYWGQGTLVTVSS

SEQ ID NO: 202 - protein, 129 aa, Artificial Sequence
  AS02626 humanized sdAb
QVQLVESGGGVVQPGRSLRLSCAASGRTITTITMGWFRQAPGKGREFVASHSWTDNNPYYADSVKGRFIISRDNSKNRLYLQMNSLRAEDTAVYYCAATARRSFVGRQWYTEARQYDYWGQGTLVTVSS

SEQ ID NO: 203 - protein, 25 aa, Artificial Sequence
  AS02640 FR1
QVQLVESGGGVVQPGRSLRLSCAAS

SEQ ID NO: 204 - protein, 25 aa, Artificial Sequence
  A34311VH11, A34311VH2, A34311VH2F53, A34311VH11F53 FR1
EVQLVESGGGVVQPGRSLRLSCAAS

SEQ ID NO: 205 - protein, 25 aa, Artificial Sequence [sequence omitted]

SEQ ID NO: 206 - protein, 25 aa, Artificial Sequence [sequence omitted]

SEQ ID NO: 207 - protein, 25 aa, Artificial Sequence [sequence omitted]

SEQ ID NO: 208 - protein, 25 aa, Artificial Sequence [sequence omitted]

SEQ ID NO: 209 - protein, 25 aa, Artificial Sequence [sequence omitted]

SEQ ID NO: 210 - protein, 25 aa, Artificial Sequence [sequence omitted]

SEQ ID NO: 211 - protein, 25 aa, Artificial Sequence [sequence omitted]

SEQ ID NO: 212 - protein, 25 aa, Artificial Sequence [sequence omitted]

SEQ ID NO: 213 - protein, 10 aa, Artificial Sequence
  AS02640 CDR1
GRTITTITMG

SEQ ID NO: 214 - protein, 10 aa, Artificial Sequence
  A34311VH11, A34311VH2, A34311VH2F53, A34311VH11F53 CDR1
GRTITTITMG

SEQ ID NO: 215 - protein, 10 aa, Artificial Sequence
  AS07014VH11 CDR1
GYTYSRHCLG

SEQ ID NO: 216 - protein, 10 aa, Artificial Sequence
  AS07014VH11G54 CDR1
GYTYSRHCLG

SEQ ID NO: 217 - protein, 10 aa, Artificial Sequence
  AS07014VH11SGA CDR1
GYTYSRHCLG

SEQ ID NO: 218 - protein, 10 aa, Artificial Sequence
  AS07014VH11SGQ CDR1
GYTYSRHCLG

SEQ ID NO: 219 - protein, 10 aa, Artificial Sequence
  AS07014VH11SGS CDR1
GYTYSRHCLG

SEQ ID NO: 220 - protein, 10 aa, Artificial Sequence
  AS07189TKDVH11 CDR1
GDSPSVNYMG

SEQ ID NO: 221 - protein, 10 aa, Artificial Sequence
  AS07189TKDVH11F27 CDR1
GFSPSVNYMG

SEQ ID NO: 222 - protein, 10 aa, Artificial Sequence
  AS07189TKDVH11FY, AS07189TKDVH21FY CDR1
GFSPSVNYMG

SEQ ID NO: 223 - protein, 14 aa, Artificial Sequence
  AS02640, A34311VH2, A34311VH2F53 FR2
WFRQAPGKGLEFVA

SEQ ID NO: 224 - protein, 14 aa, Artificial Sequence
  A34311VH11, A34311VH11F53 FR2
WFRQAPGKGREFVA

SEQ ID NO: 225 - protein, 14 aa, Artificial Sequence
  AS07014VH11 FR2
WFRQAPGKGREAVS

SEQ ID NO: 226 - protein, 14 aa, Artificial Sequence
  AS07014VH11G54 FR2
WFRQAPGKGREAVS

SEQ ID NO: 227 - protein, 14 aa, Artificial Sequence
  AS07014VH11SGA FR2
WFRQAPGKGREAVS

SEQ ID NO: 228 - protein, 14 aa, Artificial Sequence
  AS07014VH11SGQ FR2
WFRQAPGKGREAVS

SEQ ID NO: 229 - protein, 14 aa, Artificial Sequence
  AS07014VH11SGS FR2
WFRQAPGKGREAVS

SEQ ID NO: 230 - protein, 14 aa, Artificial Sequence
  AS07189TKDVH11 FR2
WFRQAPGKGREEVS

SEQ ID NO: 231 - protein, 14 aa, Artificial Sequence
  AS07189TKDVH11F27 FR2
WFRQAPGKGREEVS

SEQ ID NO: 232 - protein, 14 aa, Artificial Sequence
  AS07189TKDVH11FY FR2
WFRQAPGKGREEVS

SEQ ID NO: 233 - protein, 17 aa, Artificial Sequence
  AS02640 CDR2
SHSWTDNNPYYADSVKG

SEQ ID NO: 234 - protein, 17 aa, Artificial Sequence
  A34311VH11, A34311VH2 CDR2
SHSWTDNNPYYADSVKG

SEQ ID NO: 235 - protein, 16 aa, Artificial Sequence
  AS07014VH11 CDR2
TIDSDGSTSYADSVKG

SEQ ID NO: 236 - protein, 16 aa, Artificial Sequence
  AS07014VH11G54 CDR2
TIDSGGSTSYADSVKG

SEQ ID NO: 237 - protein, 16 aa, Artificial Sequence
  AS07014VH11SGA CDR2
TISSGGSTSYADSVKG

SEQ ID NO: 238 - protein, 16 aa, Artificial Sequence
  AS07014VH11SGQ CDR2
TISSGGSTSYADSVKG

SEQ ID NO: 239 - protein, 16 aa, Artificial Sequence
  AS07014VH11SGS CDR2
TISSGGSTSYADSVKG

SEQ ID NO: 240 - protein, 16 aa, Artificial Sequence
  AS07189TKDVH11 CDR2
SIYPTGGTFYTDSVKG

SEQ ID NO: 241 - protein, 16 aa, Artificial Sequence
  AS07189TKDVH11F27 CDR2
SIYPTGGTFYTDSVKG

SEQ ID NO: 242 - protein, 16 aa, Artificial Sequence
  AS07189TKDVH11FY, AS07189TKDVH21FY CDR2
SIYPTGGTFYTDSVKG

SEQ ID NO: 243 - protein, 32 aa, Artificial Sequence
  AS02640 FR3
RFIISRDNSKNRLYLQMNSLRAEDTAVYYCAA

SEQ ID NO: 244 - protein, 32 aa, Artificial Sequence
  A34311VH11 FR3
RFTISRDNAKNTLYLQMNSLRPEDTAVYYCAA

SEQ ID NO: 245 - protein, 32 aa, Artificial Sequence
  AS07014VH11 FR3
RFTISRDNAKNTLYLQMNSLRPEDTAVYYCAI

SEQ ID NO: 246 - protein, 32 aa, Artificial Sequence; identical to SEQ ID NO: 245
  AS07014VH11G54 FR3

SEQ ID NO: 247 - protein, 32 aa, Artificial Sequence; identical to SEQ ID NO: 245
  AS07014VH11SGA FR3

SEQ ID NO: 248 - protein, 32 aa, Artificial Sequence; identical to SEQ ID NO: 245
  AS07014VH11SGQ FR3

SEQ ID NO: 249 - protein, 32 aa, Artificial Sequence; identical to SEQ ID NO: 245
  AS07014VH11SGS FR3

SEQ ID NO: 250 - protein, 32 aa, Artificial Sequence; identical to SEQ ID NO: 244
  AS07189TKDVH11 FR3

SEQ ID NO: 251 - protein, 32 aa, Artificial Sequence; identical to SEQ ID NO: 244
  AS07189TKDVH11F27 FR3

SEQ ID NO: 252 - protein, 32 aa, Artificial Sequence; identical to SEQ ID NO: 244
  AS07189TKDVH11FY, A34311VH11F53 FR3

SEQ ID NO: 253 - protein, 20 aa, Artificial Sequence
  AS02640 CDR3
TARRSFVGRQWYTEARQYDY

SEQ ID NO: 254 - protein, 20 aa, Artificial Sequence
  A34311VH11, A34311VH2, A34311VH2F53, A34311VH11F53 CDR3
TARRSFVGRQWYTEARQYDY

SEQ ID NO: 255 - protein, 22 aa, Artificial Sequence
  AS07014VH11 CDR3
GPNPRYCSGAPNTRGAEHYFGY

SEQ ID NO: 256 - protein, 22 aa, Artificial Sequence
  AS07014VH11G54 CDR3
GPNPRYCSGAPNTRGAEHYFGY

SEQ ID NO: 257 - protein, 22 aa, Artificial Sequence
  AS07014VH11SGA CDR3
GPNPRYCSGAPATRGAEHYFGY

SEQ ID NO: 258 - protein, 22 aa, Artificial Sequence
  AS07014VH11SGQ CDR3
GPNPRYCSGAPQTRGAEHYFGY

SEQ ID NO: 259 - protein, 22 aa, Artificial Sequence
  AS07014VH11SGS CDR3
GPNPRYCSGAPSTRGAEHYFGY

SEQ ID NO: 260 - protein, 7 aa, Artificial Sequence
  AS07189TKDVH11 CDR3
GKWGTDY

SEQ ID NO: 261 - protein, 7 aa, Artificial Sequence
  AS07189TKDVH11F27 CDR3
GKWGTDY

SEQ ID NO: 262 - protein, 7 aa, Artificial Sequence
  AS07189TKDVH11FY, AS07189TKDVH21FY CDR3
GKYGTDY

SEQ ID NO: 263 - protein, 11 aa, Artificial Sequence
  AS02640, A34311VH11, AS07014VH11,  AS07014VH11G54, AS07014VH11SGA, AS07014VH11SGQ, AS07014VH11SGS, AS07189TKDVH11, AS07189TKDVH11F27, AS07189TKDVH11FY, AS07189TKDVH21FY, A34311VH2, A34311VH2F53, A34311VH11F53, AS07014 direct grafted, AS07189 direct grafted FR4
WGQGTLVTVSS

SEQ ID NO: 264 - DNA, 387 bp, Artificial Sequence
  AS02640 sdAb
caagttcaactggtggaaagcggcggcggcgtggtgcaaccgggtcgtagcctgcgtctgagctgcgcggcgagcggtcgtaccatcaccaccatcaccatgggttggttccgtcaggcgccgggcaagggtcttgaatttgtggcgagccacagctggaccgacaacaacccgtactatgcggatagcgttaagggccgtttcatcattagccgtgacaacagcaaaaacaggctgtacctgcagatgaacagcctgcgtgcggaggataccgcggtgtactattgcgcggcgaccgcgcgtcgtagctttgttggtcgtcaatggtacaccgaggcgcgtcaatacgattactggggccaaggcaccctggttaccgtgagcagc

SEQ ID NO: 265 - DNA, 387 bp, Artificial Sequence
  A34311VH11 sdAb
gaagtgcagctggtggaaagtggagggggcgtggtgcagcctggaagaagcctgagactgtcctgtgccgcatctgggagaactattaccacaatcaccatgggatggttccgacaggctccaggcaagggaagagagtttgtggcaagccactcctggacagacaacaatccttactatgccgattctgtcaagggcaggttcacaatttctcgcgacaacgccaaaaatactctgtacctgcagatgaactcactgcgacccgaagatactgccgtgtactattgcgcagctaccgctcgacggagcttcgtcgggagacagtggtacaccgaagcaagacagtatgattattggggacagggcactctggtcaccgtcagcagt

SEQ ID NO: 266 - DNA, 390 bp, Artificial Sequence
  AS07014VH11 sdAb
gaggtgcagctggtggaatctgggggaggactggtgcagcctgggggaagcctgagactgagttgtgccgcaagcggatacacttacagcaggcactgcctgggatggttccgacaggcaccaggcaagggacgagaggccgtgtctaccatcgacagtgatgggagcacatcctacgctgactcagtcaagggacggtttactatcagcagagataacgcaaagaacaccctgtatctgcagatgaactccctgagaccagaagacacagccgtgtactattgcgctatcggacccaaccctcggtactgttctggcgcccccaatacccggggagccgaacattactttgggtattggggacagggcacactggtgaccgtgagcagc

SEQ ID NO: 267 - DNA, 390 bp, Artificial Sequence
  AS07014VH11G54 sdAb
gaagtccaactggtcgaatcgggtggtggtctggtccaaccgggcggctccctgcgtctgtcgtgtgcggcgtcgggctatacctattcccgtcattgcctgggttggtttcgtcaggcaccgggcaaaggtcgtgaagctgtgagtaccattgattccggcggtagcacgtcttatgcggactcagttaaaggtcgtttcaccatctcgcgcgataacgccaaaaatacgctgtacctgcaaatgaacagcctgcgcccggaagacaccgcggtctattactgcgccattggcccgaacccgcgttattgttctggtgcgccgaatacgcgtggtgcggaacattactttggctactggggtcagggtacgctggttacggtgtcctcg

SEQ ID NO: 268 - DNA, 390 bp, Artificial Sequence
  AS07014VH11SGA sdAb
gaagtccaactggtcgaaagtggtggtggcctggtccaaccgggcggctcgctgcgtctgtcgtgtgctgcgtctggctatacctacagccgtcattgcctgggttggtttcgtcaggcaccgggcaaaggtcgtgaagccgtgtctaccattagctctggcggtagtacgtcctatgcagattcagttaaaggtcgtttcaccatctcgcgcgacaacgccaaaaatacgctgtacctgcaaatgaactccctgcgcccggaagataccgcagtctattactgcgctattggcccgaatccgcgttattgtagcggtgcgccggccacgcgcggcgcagaacactatttcggctactggggtcagggcacgctggttaccgtttcgtcg

SEQ ID NO: 269 - DNA, 390 bp, Artificial Sequence
  AS07014VH11SGQ sdAb
gaagtccaactggtcgaaagcggcggcggcctggtccaaccgggcggctcactgcgtctgtcctgtgcggcatcgggctacacctatagccgtcattgcctgggttggtttcgtcaggcaccgggcaaaggtcgtgaagctgtgtctaccattagctctggcggtagtacgtcctatgcggattcagttaaaggtcgtttcaccatctcgcgcgacaacgccaaaaatacgctgtacctgcagatgaactccctgcgcccggaagataccgcggtctattactgcgccattggcccgaatccgcgttattgtagcggtgcgccgcaaacgcgtggtgcggaacattactttggttattggggtcagggtacgctggttacggtttcgtcg

SEQ ID NO: 270 - DNA, 390 bp, Artificial Sequence
  AS07014VH11SGS sdAb
gaagtccaactggtcgaatcgggcggcggcctggtccaaccgggtggctcactgcgtctgtcctgtgcggcaagcggctacacgtattcccgtcattgcctgggttggtttcgtcaggcaccgggcaaaggtcgtgaagctgtgagcaccattagctctggcggtagtacgtcctatgcggatagcgttaaaggtcgtttcaccatctctcgcgacaacgccaaaaatacgctgtacctgcaaatgaacagtctgcgcccggaagataccgcggtctattactgcgccattggcccgaatccgcgttattgttcaggtgcgccgtcgacgcgcggtgccgaacattattttggttactggggtcagggtacgctggtcacggtttcatca

SEQ ID NO: 271 - DNA, 345 bp, Artificial Sequence
  AS07189TKDVH11 sdAb
gaggtgcagctggtggaaagcggggggggcctggtgcagcctggaggaagcctgagactgagttgtgccgcaagtggcgatagcccaagcgtgaactacatggggtggttcaggcaggcaccaggaaagggacgagaggaagtgagctccatctaccctaccggcgggacattctatactgactctgtcaagggccggtttaccattagtagagataacgccaaaaatacactgtatctgcagatgaacagcctgcgacccgaggacaccgctgtctactattgcgctgctgggaaatgggggaccgactattggggacaggggacactggtgaccgtctcatca

SEQ ID NO: 272 - DNA, 345 bp, Artificial Sequence
  AS07189TKDVH11F27 sdAb
gaagtgcaactggtggaatcgggtggtggtctggttcagccgggtggtagcctgcgtctgtcctgtgcggcaagcggtttttcgccgagcgtcaactatatgggctggtttcgtcaggcgccgggcaaaggtcgcgaagaagtgagctctatctatccgaccggcggcacgttttacaccgatagtgttaaaggtcgtttcacgatctcccgcgacaacgcgaaaaataccctgtacctgcaaatgaatagcctgcgtccggaagatacggccgtttattactgcgcggcaggcaaatggggcacggattactggggtcagggcacgctggtcacggtgtcgtcc

SEQ ID NO: 273 - DNA, 345 bp, Artificial Sequence
  AS07189TKDVH11FY sdAb
gaagtgcagctggtggaaagcggaggaggactggtgcagcctggcggaagcctgagactgagttgtgccgcatctgggtttagccccagcgtgaactacatggggtggttcaggcaggcaccaggaaagggacgagaggaagtgagctccatctaccctaccggcgggacattctatactgactctgtcaagggccggtttaccattagtagagataacgccaaaaatacactgtatctgcagatgaacagcctgcgacccgaggacaccgctgtctactattgcgcagcagggaaatacggaaccgattactgggggcagggaactctggtcactgtcagcagc

SEQ ID NO: 274 - protein, 129 aa, Artificial Sequence
  A34311VH11 humanized sdAb
EVQLVESGGGVVQPGRSLRLSCAASGRTITTITMGWFRQAPGKGREFVASHSWTDNNPYYADSVKGRFTISRDNAKNTLYLQMNSLRPEDTAVYYCAATARRSFVGRQWYTEARQYDYWGQGTLVTVSS

SEQ ID NO: 275 - protein, 130 aa, Artificial Sequence
  AS07014VH11 humanized sdAb
EVQLVESGGGLVQPGGSLRLSCAASGYTYSRHCLGWFRQAPGKGREAVSTIDSDGSTSYADSVKGRFTISRDNAKNTLYLQMNSLRPEDTAVYYCAIGPNPRYCSGAPNTRGAEHYFGYWGQGTLVTVSS

SEQ ID NO: 276 - protein, 130 aa, Artificial Sequence
  AS07014VH11G54 humanized sdAb
EVQLVESGGGLVQPGGSLRLSCAASGYTYSRHCLGWFRQAPGKGREAVSTIDSGGSTSYADSVKGRFTISRDNAKNTLYLQMNSLRPEDTAVYYCAIGPNPRYCSGAPNTRGAEHYFGYWGQGTLVTVSS

SEQ ID NO: 277 - protein, 130 aa, Artificial Sequence
  AS07014VH11SGA humanized sdAb
EVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPATRGAEHYFGYWGQGTLVTVSS

SEQ ID NO: 278 - protein, 130 aa, Artificial Sequence
  AS07014VH11SGQ humanized sdAb
EVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPQTRGAEHYFGYWGQGTLVTVSS

SEQ ID NO: 279 - protein, 130 aa, Artificial Sequence
  AS07014VH11SGS humanized sdAb
EVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPSTRGAEHYFGYWGQGTLVTVSS

SEQ ID NO: 280 - protein, 115 aa, Artificial Sequence
  AS07189TKDVH11 humanized sdAb
EVQLVESGGGLVQPGGSLRLSCAASGDSPSVNYMGWFRQAPGKGREEVSSIYPTGGTFYTDSVKGRFTISRDNAKNTLYLQMNSLRPEDTAVYYCAAGKWGTDYWGQGTLVTVSS

SEQ ID NO: 281 - protein, 115 aa, Artificial Sequence
  AS07189TKDVH11F27 humanized sdAb
EVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKWGTDYWGQGTLVTVSS

SEQ ID NO: 282 - protein, 115 aa, Artificial Sequence
  AS07189TKDVH11FY humanized sdAb
EVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKYGTDYWGQGTLVTVSS

SEQ ID NO: 283 - protein, 361 aa, Artificial Sequence
  A34311VH11 HCAb dimeric form
EVQLVESGGGVVQPGRSLRLSCAASGRTITTITMGWFRQAPGKGREFVASHSWTDNNPYYADSVKGRFTISRDNAKNTLYLQMNSLRPEDTAVYYCAATARRSFVGRQWYTEARQYDYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - protein, 362 aa, Artificial Sequence
  AS07014VH11 HCAb dimeric form
EVQLVESGGGLVQPGGSLRLSCAASGYTYSRHCLGWFRQAPGKGREAVSTIDSDGSTSYADSVKGRFTISRDNAKNTLYLQMNSLRPEDTAVYYCAIGPNPRYCSGAPNTRGAEHYFGYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 362 aa, Artificial Sequence
  AS07014VH11G54 HCAb dimeric form
EVQLVESGGGLVQPGGSLRLSCAASGYTYSRHCLGWFRQAPGKGREAVSTIDSGGSTSYADSVKGRFTISRDNAKNTLYLQMNSLRPEDTAVYYCAIGPNPRYCSGAPNTRGAEHYFGYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - protein, 362 aa, Artificial Sequence
  AS07014VH11SGA HCAb dimeric form
EVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPATRGAEHYFGYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - protein, 362 aa, Artificial Sequence
  AS07014VH11SGQ HCAb dimeric form
EVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPQTRGAEHYFGYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 288 - protein, 362 aa, Artificial Sequence
  AS07014VH11SGS HCAb dimeric form
EVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPSTRGAEHYFGYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 289 - protein, 347 aa, Artificial Sequence
  AS07189TKDVH11 HCAb dimeric form
EVQLVESGGGLVQPGGSLRLSCAASGDSPSVNYMGWFRQAPGKGREEVSSIYPTGGTFYTDSVKGRFTISRDNAKNTLYLQMNSLRPEDTAVYYCAAGKWGTDYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 347 aa, Artificial Sequence
  AS07189TKDVH11F27 HCAb dimeric form
EVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKWGTDYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 347 aa, Artificial Sequence
  AS07189TKDVH11FY HCAb dimeric form
EVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKYGTDYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 591 aa, Artificial Sequence
  BCP-73 heavy chain fusion polypeptide
EVQLVESGGGVVQPGRSLRLSCAASGRTITTITMGWFRQAPGKGREFVASHSWTDNNPYYADSVKGRFTISRDNAKNTLYLQMNSLRPEDTAVYYCAATARRSFVGRQWYTEARQYDYWGQGTLVTVSSEPKSSDKTHTSPPSPQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 293 - protein, 592 aa, Artificial Sequence
  BCP-74 heavy chain fusion polypeptide
EVQLVESGGGLVQPGGSLRLSCAASGYTYSRHCLGWFRQAPGKGREAVSTIDSDGSTSYADSVKGRFTISRDNAKNTLYLQMNSLRPEDTAVYYCAIGPNPRYCSGAPNTRGAEHYFGYWGQGTLVTVSSEPKSSDKTHTSPPSPQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 294 - protein, 577 aa, Artificial Sequence
  BCP-75 heavy chain fusion polypeptide
EVQLVESGGGLVQPGGSLRLSCAASGDSPSVNYMGWFRQAPGKGREEVSSIYPTGGTFYTDSVKGRFTISRDNAKNTLYLQMNSLRPEDTAVYYCAAGKWGTDYWGQGTLVTVSSEPKSSDKTHTSPPSPQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 295 - protein, 592 aa, Artificial Sequence
  BCP-90 heavy chain fusion polypeptide
EVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPQTRGAEHYFGYWGQGTLVTVSSEPKSSDKTHTSPPSPQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 296 - protein, 577 aa, Artificial Sequence
  BCP-91 heavy chain fusion polypeptide
EVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKYGTDYWGQGTLVTVSSEPKSSDKTHTSPPSPQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 297 - protein, 583 aa, Artificial Sequence
  BCP-78 heavy chain fusion polypeptide
EVQLVESGGGVVQPGRSLRLSCAASGRTITTITMGWFRQAPGKGREFVASHSWTDNNPYYADSVKGRFTISRDNAKNTLYLQMNSLRPEDTAVYYCAATARRSFVGRQWYTEARQYDYWGQGTLVTVSSEPKSSDKTHTSPPSPQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLVDKSRWQEGNVFSCSVMHEALHNHYTQKSLSLSLGK

SEQ ID NO: 298 - protein, 585 aa, Artificial Sequence
  BCP-79 heavy chain fusion polypeptide
EVQLVESGGGLVQPGGSLRLSCAASGYTYSRHCLGWFRQAPGKGREAVSTIDSDGSTSYADSVKGRFTISRDNAKNTLYLQMNSLRPEDTAVYYCAIGPNPRYCSGAPNTRGAEHYFGYWGQGTLVTVSSEPKSSDKTHTSPPSPQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 299 - protein, 570 aa, Artificial Sequence
  BCP-80 heavy chain fusion polypeptide
EVQLVESGGGLVQPGGSLRLSCAASGDSPSVNYMGWFRQAPGKGREEVSSIYPTGGTFYTDSVKGRFTISRDNAKNTLYLQMNSLRPEDTAVYYCAAGKWGTDYWGQGTLVTVSSEPKSSDKTHTSPPSPQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 300 - protein, 585 aa, Artificial Sequence
  BCP-94 heavy chain fusion polypeptide
EVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPQTRGAEHYFGYWGQGTLVTVSSEPKSSDKTHTSPPSPQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 301 - protein, 570 aa, Artificial Sequence
  BCP-95 heavy chain fusion polypeptide
EVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKYGTDYWGQGTLVTVSSEPKSSDKTHTSPPSPQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 302 - protein, 592 aa, Artificial Sequence
  BCP-83 heavy chain fusion polypeptide
EVQLVESGGGVVQPGRSLRLSCAASGRTITTITMGWFRQAPGKGREFVASHSWTDNNPYYADSVKGRFTISRDNAKNTLYLQMNSLRPEDTAVYYCAATARRSFVGRQWYTEARQYDYWGQGTLVTVSSEPKSSDKTHTSPPSPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - protein, 593 aa, Artificial Sequence
  BCP-84 heavy chain fusion polypeptide
EVQLVESGGGLVQPGGSLRLSCAASGYTYSRHCLGWFRQAPGKGREAVSTIDSDGSTSYADSVKGRFTISRDNAKNTLYLQMNSLRPEDTAVYYCAIGPNPRYCSGAPNTRGAEHYFGYWGQGTLVTVSSEPKSSDKTHTSPPSPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 304 - protein, 578 aa, Artificial Sequence
  BCP-85 heavy chain fusion polypeptide
EVQLVESGGGLVQPGGSLRLSCAASGDSPSVNYMGWFRQAPGKGREEVSSIYPTGGTFYTDSVKGRFTISRDNAKNTLYLQMNSLRPEDTAVYYCAAGKWGTDYWGQGTLVTVSSEPKSSDKTHTSPPSPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 593 aa, Artificial Sequence
  BCP-92 heavy chain fusion polypeptide
EVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPQTRGAEHYFGYWGQGTLVTVSSEPKSSDKTHTSPPSPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 578 aa, Artificial Sequence
  BCP-93 heavy chain fusion polypeptide
EVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKYGTDYWGQGTLVTVSSEPKSSDKTHTSPPSPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 307 - protein, 15 aa, Artificial Sequence
  mutated human IgG1 (hIgG1) hinge
EPKSSDKTHTSPPSP

SEQ ID NO: 308 - protein, 444 aa, Artificial Sequence
  PD1BMmin heavy chain
EVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 309 - protein, 214 aa, Artificial Sequence
  PD1BMmin light chain
DIQMTQSPSSVSASVGDRVTITCKASQDVDTAVAWYQQKPGKAPKLLIYWASTRHTGVPSRFSGSGSGTDFTLTISSLQPEDFATYYCQQYSTFPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 310 - protein, 574 aa, Artificial Sequence
  BCP-100 heavy chain fusion polypeptide
EVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKYGTDYWGQGTLVTVSSEPKSSDKTHTSPPSPEVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 311 - protein, 589 aa, Artificial Sequence
  BCP-101 heavy chain fusion polypeptide
EVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPQTRGAEHYFGYWGQGTLVTVSSEPKSSDKTHTSPPSPEVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 312 - protein, 574 aa, Artificial Sequence
  BCP-103 heavy chain fusion polypeptide
EVQLVESGGGLVQPGGSLRLSCAASGFSPSVNYMGWVRQAPGKGLEEVSSIYPTGGTFYTDSVKGRFTISRDNSKNTLYLQMNSLRAEDTAVYYCAAGKYGTDYWGQGTLVTVSSEPKSSDKTHTSPPSPEVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 313 - protein, 588 aa, Artificial Sequence
  BCP-104 heavy chain fusion polypeptide
EVQLVESGGGVVQPGRSLRLSCAASGRTITTITMGWFRQAPGKGLEFVASHSWTDNNPYYADSVKGRFTISRDNSKNTLYLQMNSLRAEDTAVYYCAATARRSFVGRQWYTEARQYDYWGQGTLVTVSSEPKSSDKTHTSPPSPEVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 314 - protein, 588 aa, Artificial Sequence
  BCP-105 heavy chain fusion polypeptide
EVQLVESGGGVVQPGRSLRLSCAASGRTITTITMGWFRQAPGKGLEFVASHSFTDNNPYYADSVKGRFTISRDNSKNTLYLQMNSLRAEDTAVYYCAATARRSFVGRQWYTEARQYDYWGQGTLVTVSSEPKSSDKTHTSPPSPEVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 315 - protein, 588 aa, Artificial Sequence
  BCP-106 heavy chain fusion polypeptide
EVQLVESGGGVVQPGRSLRLSCAASGRTITTITMGWFRQAPGKGREFVASHSWTDNNPYYADSVKGRFTISRDNAKNTLYLQMNSLRPEDTAVYYCAATARRSFVGRQWYTEARQYDYWGQGTLVTVSSEPKSSDKTHTSPPSPEVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 316 - protein, 588 aa, Artificial Sequence
  BCP-107 heavy chain fusion polypeptide
EVQLVESGGGVVQPGRSLRLSCAASGRTITTITMGWFRQAPGKGREFVASHSFTDNNPYYADSVKGRFTISRDNAKNTLYLQMNSLRPEDTAVYYCAATARRSFVGRQWYTEARQYDYWGQGTLVTVSSEPKSSDKTHTSPPSPEVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 317 - protein, 589 aa, Artificial Sequence
  BCP-108 heavy chain fusion polypeptide
EVQLVESGGGLVQPGGSLRLSCAASGYTYSRHCLGWFRQAPGKGREAVSTIDSDGSTSYADSVKGRFTISRDNAKNTLYLQMNSLRPEDTAVYYCAIGPNPRYCSGAPNTRGAEHYFGYWGQGTLVTVSSEPKSSDKTHTSPPSPEVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 318 - protein, 574 aa, Artificial Sequence
  BCP-109 heavy chain fusion polypeptide
EVQLVESGGGLVQPGGSLRLSCAASGDSPSVNYMGWFRQAPGKGREEVSSIYPTGGTFYTDSVKGRFTISRDNAKNTLYLQMNSLRPEDTAVYYCAAGKWGTDYWGQGTLVTVSSEPKSSDKTHTSPPSPEVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 319 - protein, 591 aa, Artificial Sequence
  BCP-73C heavy chain fusion polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGVVQPGRSLRLSCAASGRTITTITMGWFRQAPGKGREFVASHSWTDNNPYYADSVKGRFTISRDNAKNTLYLQMNSLRPEDTAVYYCAATARRSFVGRQWYTEARQYDYWGQGTLVTVSS

SEQ ID NO: 320 - protein, 592 aa, Artificial Sequence
  BCP-74C heavy chain fusion polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGYTYSRHCLGWFRQAPGKGREAVSTIDSDGSTSYADSVKGRFTISRDNAKNTLYLQMNSLRPEDTAVYYCAIGPNPRYCSGAPNTRGAEHYFGYWGQGTLVTVSS

SEQ ID NO: 321 - protein, 577 aa, Artificial Sequence
  BCP-75C heavy chain fusion polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGDSPSVNYMGWFRQAPGKGREEVSSIYPTGGTFYTDSVKGRFTISRDNAKNTLYLQMNSLRPEDTAVYYCAAGKWGTDYWGQGTLVTVSS

SEQ ID NO: 322 - protein, 592 aa, Artificial Sequence
  BCP-90C heavy chain fusion polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPQTRGAEHYFGYWGQGTLVTVSS

SEQ ID NO: 323 - protein, 577 aa, Artificial Sequence
  BCP-91C heavy chain fusion polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKYGTDYWGQGTLVTVSS

SEQ ID NO: 324 - protein, 583 aa, Artificial Sequence
  BCP-78C heavy chain fusion polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLVDKSRWQEGNVFSCSVMHEALHNHYTQKSLSLSLGKEPKSSDKTHTSPPSPEVQLVESGGGVVQPGRSLRLSCAASGRTITTITMGWFRQAPGKGREFVASHSWTDNNPYYADSVKGRFTISRDNAKNTLYLQMNSLRPEDTAVYYCAATARRSFVGRQWYTEARQYDYWGQGTLVTVSS

SEQ ID NO: 325 - protein, 585 aa, Artificial Sequence
  BCP-79C heavy chain fusion polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGYTYSRHCLGWFRQAPGKGREAVSTIDSDGSTSYADSVKGRFTISRDNAKNTLYLQMNSLRPEDTAVYYCAIGPNPRYCSGAPNTRGAEHYFGYWGQGTLVTVSS

SEQ ID NO: 326 - protein, 570 aa, Artificial Sequence
  BCP-80C heavy chain fusion polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGDSPSVNYMGWFRQAPGKGREEVSSIYPTGGTFYTDSVKGRFTISRDNAKNTLYLQMNSLRPEDTAVYYCAAGKWGTDYWGQGTLVTVSS

SEQ ID NO: 327 - protein, 585 aa, Artificial Sequence
  BCP-94C heavy chain fusion polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPQTRGAEHYFGYWGQGTLVTVSS

SEQ ID NO: 328 - protein, 570 aa, Artificial Sequence
  BCP-95C heavy chain fusion polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKYGTDYWGQGTLVTVSS

SEQ ID NO: 329 - protein, 574 aa, Artificial Sequence
  BCP-100C heavy chain fusion polypeptide
EVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKYGTDYWGQGTLVTVSS

SEQ ID NO: 330 - protein, 589 aa, Artificial Sequence
  BCP-101C heavy chain fusion polypeptide
EVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPQTRGAEHYFGYWGQGTLVTVSS

SEQ ID NO: 331 - protein, 574 aa, Artificial Sequence
  BCP-103C heavy chain fusion polypeptide
EVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGFSPSVNYMGWVRQAPGKGLEEVSSIYPTGGTFYTDSVKGRFTISRDNSKNTLYLQMNSLRAEDTAVYYCAAGKYGTDYWGQGTLVTVSS

SEQ ID NO: 332 - protein, 588 aa, Artificial Sequence
  BCP-104C heavy chain fusion polypeptide
EVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGVVQPGRSLRLSCAASGRTITTITMGWFRQAPGKGLEFVASHSWTDNNPYYADSVKGRFTISRDNSKNTLYLQMNSLRAEDTAVYYCAATARRSFVGRQWYTEARQYDYWGQGTLVTVSS

SEQ ID NO: 333 - protein, 588 aa, Artificial Sequence
  BCP-105C heavy chain fusion polypeptide
EVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGVVQPGRSLRLSCAASGRTITTITMGWFRQAPGKGLEFVASHSFTDNNPYYADSVKGRFTISRDNSKNTLYLQMNSLRAEDTAVYYCAATARRSFVGRQWYTEARQYDYWGQGTLVTVSS

SEQ ID NO: 334 - protein, 588 aa, Artificial Sequence
  BCP-106C heavy chain fusion polypeptide
EVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGVVQPGRSLRLSCAASGRTITTITMGWFRQAPGKGREFVASHSWTDNNPYYADSVKGRFTISRDNAKNTLYLQMNSLRPEDTAVYYCAATARRSFVGRQWYTEARQYDYWGQGTLVTVSS

SEQ ID NO: 335 - protein, 588 aa, Artificial Sequence
  BCP-107C heavy chain fusion polypeptide
EVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGVVQPGRSLRLSCAASGRTITTITMGWFRQAPGKGREFVASHSFTDNNPYYADSVKGRFTISRDNAKNTLYLQMNSLRPEDTAVYYCAATARRSFVGRQWYTEARQYDYWGQGTLVTVSS

SEQ ID NO: 336 - protein, 589 aa, Artificial Sequence
  BCP-108C heavy chain fusion polypeptide
EVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGYTYSRHCLGWFRQAPGKGREAVSTIDSDGSTSYADSVKGRFTISRDNAKNTLYLQMNSLRPEDTAVYYCAIGPNPRYCSGAPNTRGAEHYFGYWGQGTLVTVSS

SEQ ID NO: 337 - protein, 574 aa, Artificial Sequence
  BCP-109C heavy chain fusion polypeptide
EVQLVESGGGLVQPGGSLRLSCAASGFVFSRYDMAWVRQAPGKGLEWVSFISGGGSNTYYPDTVKGRFTISRDNSKNTLYLQMNSLRAEDTAVYYCISPYYYAMEYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKEPKSSDKTHTSPPSPEVQLVESGGGLVQPGGSLRLSCAASGDSPSVNYMGWFRQAPGKGREEVSSIYPTGGTFYTDSVKGRFTISRDNAKNTLYLQMNSLRPEDTAVYYCAAGKWGTDYWGQGTLVTVSS

SEQ ID NO: 338 - protein, 14 aa, Artificial Sequence
  AS07189TKDVH21FY FR2
WVRQAPGKGLEEVS

SEQ ID NO: 339 - protein, 17 aa, Artificial Sequence
  A34311VH2F53, A34311VH11F53 CDR2
SHSFTDNNPYYADSVKG

SEQ ID NO: 340 - protein, 32 aa, Artificial Sequence
  AS07189TKDVH21FY, A34311VH2, A34311VH2F53 FR3
RFTISRDNSKNTLYLQMNSLRAEDTAVYYCAA

SEQ ID NO: 341 - protein, 115 aa, Artificial Sequence
  AS07189TKDVH21FY humanized sdAb
EVQLVESGGGLVQPGGSLRLSCAASGFSPSVNYMGWVRQAPGKGLEEVSSIYPTGGTFYTDSVKGRFTISRDNSKNTLYLQMNSLRAEDTAVYYCAAGKYGTDYWGQGTLVTVSS

SEQ ID NO: 342 - protein, 129 aa, Artificial Sequence
  A34311VH2 humanized sdAb
EVQLVESGGGVVQPGRSLRLSCAASGRTITTITMGWFRQAPGKGLEFVASHSWTDNNPYYADSVKGRFTISRDNSKNTLYLQMNSLRAEDTAVYYCAATARRSFVGRQWYTEARQYDYWGQGTLVTVSS

SEQ ID NO: 343 - protein, 129 aa, Artificial Sequence
  A34311VH2F53 humanized sdAb
EVQLVESGGGVVQPGRSLRLSCAASGRTITTITMGWFRQAPGKGLEFVASHSFTDNNPYYADSVKGRFTISRDNSKNTLYLQMNSLRAEDTAVYYCAATARRSFVGRQWYTEARQYDYWGQGTLVTVSS

SEQ ID NO: 344 - protein, 129 aa, Artificial Sequence
  A34311VH11F53 humanized sdAb
EVQLVESGGGVVQPGRSLRLSCAASGRTITTITMGWFRQAPGKGREFVASHSFTDNNPYYADSVKGRFTISRDNAKNTLYLQMNSLRPEDTAVYYCAATARRSFVGRQWYTEARQYDYWGQGTLVTVSS

SEQ ID NO: 345 - protein, 592 aa, Artificial Sequence
  BCP-83C heavy chain fusion polypeptide
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKEPKSSDKTHTSPPSPEVQLVESGGGVVQPGRSLRLSCAASGRTITTITMGWFRQAPGKGREFVASHSWTDNNPYYADSVKGRFTISRDNAKNTLYLQMNSLRPEDTAVYYCAATARRSFVGRQWYTEARQYDYWGQGTLVTVSS

SEQ ID NO: 346 - protein, 593 aa, Artificial Sequence
  BCP-84C heavy chain fusion polypeptide
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKEPKSSDKTHTSPPSPEVQLVESGGGLVQPGGSLRLSCAASGYTYSRHCLGWFRQAPGKGREAVSTIDSDGSTSYADSVKGRFTISRDNAKNTLYLQMNSLRPEDTAVYYCAIGPNPRYCSGAPNTRGAEHYFGYWGQGTLVTVSS

SEQ ID NO: 347 - protein, 578 aa, Artificial Sequence
  BCP-85C heavy chain fusion polypeptide
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKEPKSSDKTHTSPPSPEVQLVESGGGLVQPGGSLRLSCAASGDSPSVNYMGWFRQAPGKGREEVSSIYPTGGTFYTDSVKGRFTISRDNAKNTLYLQMNSLRPEDTAVYYCAAGKWGTDYWGQGTLVTVSS

SEQ ID NO: 348 - protein, 593 aa, Artificial Sequence
  BCP-92C heavy chain fusion polypeptide
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKEPKSSDKTHTSPPSPEVQLVESGGGLVQPGGSLRLSCAASGYTYSRHCLGWFRQAPGKGREAVSTISSGGSTSYADSVKGRFTISRDNAKNTLYLQMNSLRPEDTAVYYCAIGPNPRYCSGAPQTRGAEHYFGYWGQGTLVTVSS

SEQ ID NO: 349 - protein, 578 aa, Artificial Sequence
  BCP-93C heavy chain fusion polypeptide
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKEPKSSDKTHTSPPSPEVQLVESGGGLVQPGGSLRLSCAASGFSPSVNYMGWFRQAPGKGREEVSSIYPTGGTFYTDSVKGRFTISRDNAKNTLYLQMNSLRPEDTAVYYCAAGKYGTDYWGQGTLVTVSS

SEQ ID NO: 350 - protein, 14 aa, Artificial Sequence
  AS07014 direct grafted, AS07189 direct grafted FR2
WVRQAPGKGLEWVS

SEQ ID NO: 351 - protein, 32 aa, Artificial Sequence
  AS07014 direct grafted, AS07189 direct grafted FR3
RFTISRDNSKNTLYLQMNSLRAEDTAVYYCAR

SEQ ID NO: 352 - protein, 130 aa, Artificial Sequence
  AS07014 direct grafted humanized sdAb
EVQLVESGGGLVQPGGSLRLSCAASGYTYSRHCLGWVRQAPGKGLEWVSTIDSDGSTSYADSVKGRFTISRDNSKNTLYLQMNSLRAEDTAVYYCARGPNPRYCSGAPNTRGAEHYFGYWGQGTLVTVSS

SEQ ID NO: 353 - protein, 115 aa, Artificial Sequence
  AS07189 direct grafted humanized sdAb
EVQLVESGGGLVQPGGSLRLSCAASGFSPSVNYMGWVRQAPGKGLEWVSSIYPTGGTFYTDSVKGRFTISRDNSKNTLYLQMNSLRAEDTAVYYCARGKWGTDYWGQGTLVTVSS

SEQ ID NO: 354 - protein, 362 aa, Artificial Sequence
  BCP-16 light chain fusion polypeptide
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEPKSCDKTHTCPPCPEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 355 - protein, 362 aa, Artificial Sequence
  BCP-17 light chain fusion polypeptide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEPKSCDKTHTCPPCPQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSS

SEQ ID NO: 356 - protein, 585 aa, Artificial Sequence; identical to SEQ ID NO: 135
  BCP-31 heavy chain fusion polypeptide

SEQ ID NO: 357 - protein, 356 aa, Artificial Sequence
  BCP-31 light chain fusion polypeptide
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSGGGGSGGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 358 - protein, 723 aa, Artificial Sequence
  BCP-32 heavy chain fusion polypeptide
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSGGGGSGGGSQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSGGGGSGGGSQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 359 - protein, 594 aa, Artificial Sequence
  BCP-33 heavy chain fusion polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 360 - protein, 622 aa, Artificial Sequence
  BCP-34
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKGGGGSGGGGSGGGGSQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSEPKSCDKTHTCPPCPQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 692 aa, Artificial Sequence
  BCP-35 heavy chain fusion polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 362 - protein, 469 aa, Artificial Sequence
  BCP-35 light chain fusion polypeptide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEPKSCDKTHTCPPCPQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 363 - protein, 720 aa, Artificial Sequence
  BCP-36 heavy chain fusion polypeptide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKGGGGSGGGGSGGGGSQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSEPKSCDKTHTCPPCPQVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 364 - protein, 236 aa, Artificial Sequence
  BCP-36 light chain fusion polypeptide
QVKLEESGGGLVLPGESLRLSCEASGRTITTITMGWFRQAPGKERQFVASHSWTDNNPYYADSVKGRFIISRDNAGNRVYLQMHSLEPEDTAVYYCAATARRSFVGRQWYTEARQYDYWGQGTQVTVSSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 365 - protein, 15 aa, Artificial Sequence
  linker peptide
GGGGSGGGGSGGGGS

SEQ ID NO: 366 - protein, 362 aa, Artificial Sequence
  AS07014 direct grafted HCAb dimeric form
EVQLVESGGGLVQPGGSLRLSCAASGYTYSRHCLGWVRQAPGKGLEWVSTIDSDGSTSYADSVKGRFTISRDNSKNTLYLQMNSLRAEDTAVYYCARGPNPRYCSGAPNTRGAEHYFGYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 367 - protein, 347 aa, Artificial Sequence
  AS07189 direct grafted HCAb dimeric form
EVQLVESGGGLVQPGGSLRLSCAASGFSPSVNYMGWVRQAPGKGLEWVSSIYPTGGTFYTDSVKGRFTISRDNSKNTLYLQMNSLRAEDTAVYYCARGKWGTDYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 368 - protein, 347 aa, Artificial Sequence
  AS07189TKDVH21FY HCAb dimeric form
EVQLVESGGGLVQPGGSLRLSCAASGFSPSVNYMGWVRQAPGKGLEEVSSIYPTGGTFYTDSVKGRFTISRDNSKNTLYLQMNSLRAEDTAVYYCAAGKYGTDYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - protein, 361 aa, Artificial Sequence
  A34311VH2 HCAb dimeric form
EVQLVESGGGVVQPGRSLRLSCAASGRTITTITMGWFRQAPGKGLEFVASHSWTDNNPYYADSVKGRFTISRDNSKNTLYLQMNSLRAEDTAVYYCAATARRSFVGRQWYTEARQYDYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 370 - protein, 361 aa, Artificial Sequence
  A34311VH2F53 HCAb dimeric form
EVQLVESGGGVVQPGRSLRLSCAASGRTITTITMGWFRQAPGKGLEFVASHSFTDNNPYYADSVKGRFTISRDNSKNTLYLQMNSLRAEDTAVYYCAATARRSFVGRQWYTEARQYDYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - protein, 361 aa, Artificial Sequence
  A34311VH11F53 HCAb dimeric form
EVQLVESGGGVVQPGRSLRLSCAASGRTITTITMGWFRQAPGKGREFVASHSFTDNNPYYADSVKGRFTISRDNAKNTLYLQMNSLRPEDTAVYYCAATARRSFVGRQWYTEARQYDYWGQGTLVTVSSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 372 - protein, 129 aa, Artificial Sequence; identical to SEQ ID NO: 342
  A34311 consensus

SEQ ID NO: 373 - protein, 130 aa, Artificial Sequence; identical to SEQ ID NO: 276
  AS07014 consensus

SEQ ID NO: 374 - protein, 115 aa, Artificial Sequence; identical to SEQ ID NO: 281
  AS07189 consensus

SEQ ID NO: 375 - protein, 1 aa, Artificial Sequence
  Linker amino acid sequence
  VARIANT (1)...(1): Can be present in repeats of at least one time
G

SEQ ID NO: 376 - protein, 2 aa, Artificial Sequence
  Linker amino acid sequence
  VARIANT (1)...(2): Can be present in repeats of at least one time
GS

SEQ ID NO: 377 - protein, 5 aa, Artificial Sequence
  Linker amino acid sequence
  VARIANT (1)...(5): Can be present in repeats of at least one time
GSGGS

SEQ ID NO: 378 - protein, 4 aa, Artificial Sequence
  Linker amino acid sequence
  VARIANT (1)...(4): Can be present in repeats of at least one time
GGGS

SEQ ID NO: 379 - protein, 5 aa, Artificial Sequence
  Linker amino acid sequence
  VARIANT (1)...(5): Can be present in repeats of at least one time
GGGGS

What is claimed is:

1. An isolated anti-cytotoxic T-lymphocyte-associated protein 4 (anti-CTLA-4) construct comprising a single-domain antibody (sdAb) moiety specifically recognizing CTLA-4 (anti-CTLA-4 sdAb moiety), wherein the anti-CTLA-4 sdAb moiety comprises any one of the following:

(1) a CDR1 comprising the amino acid sequence of SEQ ID NO: 24, a CDR2 comprising the amino acid sequence of SEQ ID NO: 56, and a CDR3 comprising the amino acid sequence of SEQ ID NO: 88;

(2) a CDR1 comprising the amino acid sequence of SEQ ID NO: 18, a CDR2 comprising the amino acid sequence of SEQ ID NO: 50, and a CDR3 comprising the amino acid sequence of SEQ ID NO: 82;

(3) a CDR1 comprising the amino acid sequence of SEQ ID NO: 26, a CDR2 comprising the amino acid sequence of SEQ ID NO: 58, and a CDR3 comprising the amino acid sequence of SEQ ID NO: 90;

(4) a CDR1 comprising the amino acid sequence of SEQ ID NO: 213, a CDR2 comprising the amino acid sequence of SEQ ID NO: 233, and a CDR3 comprising the amino acid sequence of SEQ ID NO: 253;

(5) a CDR1 comprising the amino acid sequence of SEQ ID NO: 17, a CDR2 comprising the amino acid sequence of SEQ ID NO: 49, and a CDR3 comprising the amino acid sequence of SEQ ID NO: 81;

(6) a CDR1 comprising the amino acid sequence of SEQ ID NO: 19, a CDR2 comprising the amino acid sequence of SEQ ID NO: 51, and a CDR3 comprising the amino acid sequence of SEQ ID NO: 83;

(7) a CDR1 comprising the amino acid sequence of SEQ ID NO: 20, a CDR2 comprising the amino acid sequence of SEQ ID NO: 52, and a CDR3 comprising the amino acid sequence of SEQ ID NO: 84;

(8) a CDR1 comprising the amino acid sequence of SEQ ID NO: 21, a CDR2 comprising the amino acid sequence of SEQ ID NO: 53, and a CDR3 comprising the amino acid sequence of SEQ ID NO: 85;

(9) a CDR1 comprising the amino acid sequence of SEQ ID NO: 22, a CDR2 comprising the amino acid sequence of SEQ ID NO: 54, and a CDR3 comprising the amino acid sequence of SEQ ID NO: 86;

(10) a CDR1 comprising the amino acid sequence of SEQ ID NO: 23, a CDR2 comprising the amino acid sequence of SEQ ID NO: 55, and a CDR3 comprising the amino acid sequence of SEQ ID NO: 87;

(11) a CDR1 comprising the amino acid sequence of SEQ ID NO: 25, a CDR2 comprising the amino acid sequence of SEQ ID NO: 57, and a CDR3 comprising the amino acid sequence of SEQ ID NO: 89;

(12) a CDR1 comprising the amino acid sequence of SEQ ID NO: 27, a CDR2 comprising the amino acid sequence of SEQ ID NO: 59, and a CDR3 comprising the amino acid sequence of SEQ ID NO: 91;

(13) a CDR1 comprising the amino acid sequence of SEQ ID NO: 28, a CDR2 comprising the amino acid sequence of SEQ ID NO: 60, and a CDR3 comprising the amino acid sequence of SEQ ID NO: 92;

(14) a CDR1 comprising the amino acid sequence of SEQ ID NO: 29, a CDR2 comprising the amino acid sequence of SEQ ID NO: 61, and a CDR3 comprising the amino acid sequence of SEQ ID NO: 93;

(15) a CDR1 comprising the amino acid sequence of SEQ ID NO: 30, a CDR2 comprising the amino acid sequence of SEQ ID NO: 62, and a CDR3 comprising the amino acid sequence of SEQ ID NO: 94;

(16) a CDR1 comprising the amino acid sequence of SEQ ID NO: 31, a CDR2 comprising the amino acid sequence of SEQ ID NO: 63, and a CDR3 comprising the amino acid sequence of SEQ ID NO: 95;

(17) a CDR1 comprising the amino acid sequence of SEQ ID NO: 32, a CDR2 comprising the amino acid sequence of SEQ ID NO: 64, and a CDR3 comprising the amino acid sequence of SEQ ID NO: 96;

(18) a CDR1 comprising the amino acid sequence of SEQ ID NO: 214, a CDR2 comprising the amino acid sequence of SEQ ID NO: 234, and a CDR3 comprising the amino acid sequence of SEQ ID NO: 254;

(19) a CDR1 comprising the amino acid sequence of SEQ ID NO: 215, a CDR2 comprising the amino acid sequence of SEQ ID NO: 235, and a CDR3 comprising the amino acid sequence of SEQ ID NO: 255;

(20) a CDR1 comprising the amino acid sequence of SEQ ID NO: 216, a CDR2 comprising the amino acid sequence of SEQ ID NO: 236, and a CDR3 comprising the amino acid sequence of SEQ ID NO: 256;

(21) a CDR1 comprising the amino acid sequence of SEQ ID NO: 217, a CDR2 comprising the amino acid sequence of SEQ ID NO: 237, and a CDR3 comprising the amino acid sequence of SEQ ID NO: 257;

(22) a CDR1 comprising the amino acid sequence of SEQ ID NO: 218, a CDR2 comprising the amino acid sequence of SEQ ID NO: 238, and a CDR3 comprising the amino acid sequence of SEQ ID NO: 258;

(23) a CDR1 comprising the amino acid sequence of SEQ ID NO: 219, a CDR2 comprising the amino acid sequence of SEQ ID NO: 239, and a CDR3 comprising the amino acid sequence of SEQ ID NO: 259;

(24) a CDR1 comprising the amino acid sequence of SEQ ID NO: 220, a CDR2 comprising the amino acid sequence of SEQ ID NO: 240, and a CDR3 comprising the amino acid sequence of SEQ ID NO: 260;

(25) a CDR1 comprising the amino acid sequence of SEQ ID NO: 221, a CDR2 comprising the amino acid sequence of SEQ ID NO: 241, and a CDR3 comprising the amino acid sequence of SEQ ID NO: 261;

(26) a CDR1 comprising the amino acid sequence of SEQ ID NO: 222, a CDR2 comprising the amino acid sequence of SEQ ID NO: 242, and a CDR3 comprising the amino acid sequence of SEQ ID NO: 262; and

(27) a CDR1 comprising the amino acid sequence of SEQ ID NO: 214, a CDR2 comprising the amino acid sequence of SEQ ID NO: 339, and a CDR3 comprising the amino acid sequence of SEQ ID NO: 254.

2. The isolated anti-CTLA-4 construct of claim 1, wherein the anti-CTLA-4 sdAb moiety comprises a $V_HH$ domain comprising the amino acid sequence of any one of SEQ ID NOs: 113-129, 200-202, 274-282, 341-344, 352, and 353, or a variant thereof having at least 90% sequence identity to any one of SEQ ID NOs: 113-129, 200-202, 274-282, 341-344, 352, and 353.

3. The isolated anti-CTLA-4 construct of claim 1, wherein the anti-CTLA-4 sdAb moiety is camelid, chimeric, partially humanized, or fully humanized.

4. The isolated anti-CTLA-4 construct of claim 1, wherein the isolated anti-CTLA-4 construct is a heavy chain-only antibody (HCAb).

5. The isolated anti-CTLA-4 construct of claim 4, wherein the HCAb comprises the amino acid sequence of any one of SEQ ID NOs: 130-133, 283-291, and 366-371.

6. The isolated anti-CTLA-4 construct of claim 1, wherein the isolated anti-CTLA-4 construct further comprises a second antibody moiety specifically recognizing a second epitope.

7. The isolated anti-CTLA-4 construct of claim 6, wherein the second antibody moiety is a full-length antibody, a Fab, a Fab', a (Fab')2, an Fv, a single chain Fv (scFv), an scFv-scFv, a minibody, a diabody, or an sdAb.

8. The isolated anti-CTLA-4 construct of claim 6, wherein the anti-CTLA-4 sdAb moiety and the second antibody moiety are connected by a peptide linker.

9. The isolated anti-CTLA-4 construct of claim 8, wherein the peptide linker comprises the amino acid sequence of SEQ ID NO: 162, 163, 307, or 365.

10. The isolated anti-CTLA-4 construct of claim 7, wherein the second antibody moiety is a full-length antibody consisting of two heavy chains and two light chains.

11. The isolated anti-CTLA-4 construct of claim 10, comprising a configuration selected from the group consisting of:
  (1) the N-terminus of the anti-CTLA-4 sdAb moiety is fused to the C-terminus of at least one of the heavy chains of the full-length antibody;
  (2) the C-terminus of the anti-CTLA-4 sdAb moiety is fused to the N-terminus of at least one of the heavy chains of the full-length antibody;
  (3) the N-terminus of the anti-CTLA-4 sdAb moiety is fused to the C-terminus of at least one of the light chains of the full-length antibody;
  (4) the C-terminus of the anti-CTLA-4 sdAb moiety is fused to the N-terminus of at least one of the light chains of the full-length antibody;
  (5) the isolated anti-CTLA-4 construct comprises four anti-CTLA-4 sdAb moieties, wherein the C-terminus of each anti-CTLA-4 sdAb moiety is fused to the N-terminus of each chain of the full-length antibody; and
  (6) the isolated anti-CTLA-4 construct comprises four anti-CTLA-4 sdAb moieties, wherein the C-terminus of the first anti-CTLA-4 sdAb moiety is fused to the N-terminus of the second anti-CTLA-4 sdAb moiety, wherein the C-terminus of the second anti-CTLA-4 sdAb moiety is fused to the N-terminus of the first heavy chain of the full-length antibody, wherein the C-terminus of the third anti-CTLA-4 sdAb moiety is fused to the N-terminus of the fourth anti-CTLA-4 sdAb moiety, and wherein the C-terminus of the fourth anti-CTLA-4 sdAb moiety is fused to the N-terminus of the second heavy chain of the full-length antibody.

12. The isolated anti-CTLA-4 construct of claim 10, wherein the full-length antibody specifically recognizes programmed cell death protein 1 (PD-1) (anti-PD-1 full-length antibody), and wherein the anti-PD-1 full-length antibody comprises heavy chain complementarity-determining regions (HC-CDRs) and light chain complementarity-determining regions (LC-CDRs) of:
  (1) a heavy chain comprising the amino acid sequence of SEQ ID NO: 158, and a light chain comprising the amino acid sequence of SEQ ID NO: 159;
  (2) a heavy chain comprising the amino acid sequence of SEQ ID NO: 160, and a light chain comprising the amino acid sequence of SEQ ID NO: 161; or
  (3) a heavy chain comprising the amino acid sequence of SEQ ID NO: 308, and a light chain comprising the amino acid sequence of SEQ ID NO: 309.

13. The isolated anti-CTLA-4 construct of claim 10, wherein the full-length antibody specifically recognizes programmed death-ligand 1 (PD-L1) (anti-PD-L1 full-length antibody), and wherein the anti-PD-L1 full-length antibody comprises HC-CDRs and LC-CDRs of:
  (1) a heavy chain comprising the amino acid sequence of SEQ ID NO: 195, and a light chain comprising the amino acid sequence of SEQ ID NO: 196; or
  (2) a heavy chain comprising the amino acid sequence of SEQ ID NO: 197, and a light chain comprising the amino acid sequence of SEQ ID NO: 198.

14. The isolated anti-CTLA-4 construct of claim 11, wherein the full-length antibody specifically recognizes PD-1 (anti-PD-1 full-length antibody),
  (i) wherein the anti-PD-1 full-length antibody comprises two heavy chains each comprising the amino acid sequence of SEQ ID NO: 158, and two light chains each comprising the amino acid sequence of SEQ ID NO: 159; and wherein the anti-CTLA-4 sdAb moiety comprises a $V_HH$ domain comprising the amino acid sequence of any one of SEQ ID NOs: 114, 129, 274, 275, 278, 280, and 282;
  (ii) wherein the anti-PD-1 full-length antibody comprises two heavy chains each comprising the amino acid of SEQ ID NO: 160, and two light chains each comprising the amino acid sequence of SEQ ID NO: 161; and wherein the anti-CTLA-4 sdAb moiety comprises a $V_HH$ domain comprising the amino acid sequence of any one of SEQ ID NOs: 114, 129, 274, 275, 278, 280, and 282; or
  (iii) wherein the anti-PD-1 full-length antibody comprises two heavy chains each comprising the amino acid sequence of SEQ ID NO: 308, and two light chains each comprising the amino acid sequence of SEQ ID NO: 309; and wherein the anti-CTLA-4 sdAb moiety comprises a $V_HH$ domain comprising the amino acid sequence of any one of SEQ ID NOs: 274, 275, 278, 280, 282, and 341-344.

15. The isolated anti-CTLA-4 construct of claim 11, wherein the full-length antibody specifically recognizes PD-L1 (anti-PD-L1 full-length antibody),
  (i) wherein the anti-PD-L1 full-length antibody comprises two heavy chains each comprising the amino acid sequence of SEQ ID NO: 195, and two light chains each comprising the amino acid sequence of SEQ ID NO: 196; and wherein the anti-CTLA-4 sdAb moiety comprises a V$_H$H domain comprising the amino acid sequence of any one of SEQ ID NOs: 114, 129, 274, 275, 278, 280, and 282; or
(ii) wherein the anti-PD-L1 full-length antibody comprises two heavy chains each comprising the amino acid sequence of SEQ ID NO: 197, and two light chains each comprising the amino acid sequence of SEQ ID NO: 198; and wherein the anti-CTLA-4 sdAb moiety comprises a V$_H$H domain comprising the amino acid sequence of SEQ ID NO: 114 or 129.

16. The isolated anti-CTLA-4 construct of claim 14,
(i) wherein the anti-PD-1 full-length antibody comprises two heavy chains each comprising the amino acid sequence of SEQ ID NO: 158, and two light chains each comprising the amino acid sequence of SEQ ID NO: 159, wherein at least one of the heavy chains of the anti-PD-1 full-length antibody is fused to the anti-CTLA-4 sdAb moiety, and wherein the heavy chain fusion polypeptide comprises the amino acid sequence of any one of SEQ ID NOs: 134-145, 292-296, and 319-323;
(ii) wherein the anti-PD-1 full-length antibody comprises two heavy chains each comprising the amino acid sequence of SEQ ID NO: 160, and two light chains each comprising the amino acid sequence of SEQ ID NO: 161, wherein at least one of the heavy chains of the anti-PD-1 full-length antibody is fused to the anti-CTLA-4 sdAb moiety, and wherein the heavy chain fusion polypeptide comprises the amino acid sequence of any one of SEQ ID NOs: 146-157, 297-301, and 324-328;
(iii) wherein the anti-PD-1 full-length antibody comprises two heavy chains each comprising the amino acid sequence of SEQ ID NO: 308, and two light chains each comprising the amino acid sequence of SEQ ID NO: 309, wherein at least one of the heavy chains of the anti-PD-1 full-length antibody is fused to the anti-CTLA-4 sdAb moiety, and wherein the heavy chain fusion polypeptide comprises the amino acid sequence of any one of SEQ ID NOs: 310-318 and 329-337;
(iv) wherein the anti-PD-1 full-length antibody comprises two heavy chains each comprising the amino acid sequence of SEQ ID NO: 158, and two light chains each comprising the amino acid sequence of SEQ ID NO: 159, wherein at least one of the light chains of the anti-PD-1 full-length antibody is fused to the anti-CTLA-4 sdAb moiety, and wherein the light chain fusion polypeptide comprises the amino acid sequence of SEQ ID NO: 354 or 355;
(v) wherein the anti-PD-1 full-length antibody comprises two heavy chains each comprising the amino acid sequence of SEQ ID NO: 158, and two light chains each comprising the amino acid sequence of SEQ ID NO: 159, wherein the isolated anti-CTLA-4 construct comprises four anti-CTLA-4 sdAb moieties, wherein the C-terminus of each anti-CTLA-4 sdAb moiety is fused to the N-terminus of each chain of the anti-PD-1 full-length antibody, and wherein the heavy chain fusion polypeptides each comprises the amino acid sequence of SEQ ID NO: 356, and the light chain fusion polypeptides each comprises the amino acid sequence of SEQ ID NO: 357; or
(vi) wherein the anti-PD-1 full-length antibody comprises two heavy chains each comprising the amino acid sequence of SEQ ID NO: 158, and two light chains each comprising the amino acid sequence of SEQ ID NO: 159, wherein the isolated anti-CTLA-4 construct comprises four anti-CTLA-4 sdAb moieties, wherein the C-terminus of the first anti-CTLA-4 sdAb moiety is fused to the N-terminus of the second anti-CTLA-4 sdAb moiety, wherein the C-terminus of the second anti-CTLA-4 sdAb moiety is fused to the N-terminus of the first heavy chain of the anti-PD-1 full-length antibody, wherein the C-terminus of the third anti-CTLA-4 sdAb moiety is fused to the N-terminus of the fourth anti-CTLA-4 sdAb moiety, and wherein the C-terminus of the fourth anti-CTLA-4 sdAb moiety is fused to the N-terminus of the second heavy chain of the anti-PD-1 full-length antibody, and wherein the heavy chain fusion polypeptides each comprises the amino acid sequence of SEQ ID NO: 358.

17. The isolated anti-CTLA-4 construct of claim 15,
(i) wherein the anti-PD-L1 full-length antibody comprises two heavy chains each comprising the amino acid sequence of SEQ ID NO: 195, and two light chains each comprising the amino acid sequence of SEQ ID NO: 196, wherein at least one of the heavy chains of the anti-PD-L1 full-length antibody is fused to the anti-CTLA-4 sdAb moiety, and wherein the heavy chain fusion polypeptide comprises the amino acid sequence of any one of SEQ ID NOs: 171-182, 302-306, and 345-349; or
(ii) wherein the anti-PD-L1 full-length antibody comprises two heavy chains each comprising the amino acid sequence of SEQ ID NO: 197, and two light chains each comprising the amino acid sequence of SEQ ID NO: 198, wherein at least one of the heavy chains of the anti-PD-L1 full-length antibody is fused to the anti-CTLA-4 sdAb moiety, and wherein the heavy chain fusion polypeptide comprises the amino acid sequence of any one of SEQ ID NOs: 183-194.

18. The isolated anti-CTLA-4 construct of claim 14, wherein each heavy chain of the anti-PD-1 full-length antibody is fused to an anti-CTLA-4 sdAb moiety,
(i) wherein the anti-PD-1 full-length antibody comprises two heavy chains each comprising the amino acid sequence of SEQ ID NO: 158, and two light chains each comprising the amino acid sequence of SEQ ID NO: 159, and wherein each heavy chain fusion polypeptide comprises the amino acid sequence of SEQ ID NO: 292;
(ii) wherein the anti-PD-1 full-length antibody comprises two heavy chains each comprising the amino acid sequence of SEQ ID NO: 158, and two light chains each comprising the amino acid sequence of SEQ ID NO: 159, and wherein each heavy chain fusion polypeptide comprises the amino acid sequence of SEQ ID NO: 293;
(iii) wherein the anti-PD-1 full-length antibody comprises two heavy chains each comprising the amino acid sequence of SEQ ID NO: 158, and two light chains each comprising the amino acid sequence of SEQ ID NO: 159, and wherein each heavy chain fusion polypeptide comprises the amino acid sequence of SEQ ID NO: 294;
(iv) wherein the anti-PD-1 full-length antibody comprises two heavy chains each comprising the amino acid sequence of SEQ ID NO: 160, and two light chains each comprising the amino acid sequence of SEQ ID NO: 161, and wherein each heavy chain fusion polypeptide comprises the amino acid sequence of SEQ ID NO: 297;

(v) wherein the anti-PD-1 full-length antibody comprises two heavy chains each comprising the amino acid sequence of SEQ ID NO: 160, and two light chains each comprising the amino acid sequence of SEQ ID NO: 161, and wherein each heavy chain fusion polypeptide comprises the amino acid sequence of SEQ ID NO: 298; or (vi) wherein the anti-PD-1 full-length antibody comprises two heavy chains each comprising the amino acid sequence of SEQ ID NO: 160, and two light chains each comprising the amino acid sequence of SEQ ID NO: 161, and wherein each heavy chain fusion polypeptide comprises the amino acid sequence of SEQ ID NO: 299.

19. The isolated anti-CTLA-4 construct of claim 1, wherein the anti-CTLA-4 sdAb moiety comprises a $V_HH$ domain comprising the amino acid sequence of any one of SEQ ID NOs: 123, 274, 275, and 280.

20. A method of treating an individual having a CTLA-4 positive cancer, comprising administering to the individual an effective amount of the isolated anti-CTLA-4 construct of claim 3.

21. The method of claim 20, wherein the CTLA-4 positive cancer is colon cancer.

* * * * *